(12) United States Patent
Botsch et al.

(10) Patent No.: US 11,920,166 B2
(45) Date of Patent: Mar. 5, 2024

(54) VARIANT CANNABINOID SYNTHASES AND METHODS AND USES THEREOF

(71) Applicant: RENEW BIOPHARMA, INC., San Diego, CA (US)

(72) Inventors: Kyle Botsch, San Diego, CA (US); Craig Behnke, San Diego, CA (US); Karla Gonzalez, San Diego, CA (US); Matthew Saunders, San Diego, CA (US); Michael Mendez, San Diego, CA (US)

(73) Assignee: RENEW BIOPHARMA, INC., San Diego, CA (US)

( * ) Notice: Subject to any disclaimer, the term of this patent is extended or adjusted under 35 U.S.C. 154(b) by 0 days.

(21) Appl. No.: 17/869,608

(22) Filed: Jul. 20, 2022

(65) Prior Publication Data
US 2023/0203455 A1 Jun. 29, 2023

Related U.S. Application Data

(63) Continuation of application No. 17/049,822, filed as application No. PCT/US2019/028806 on Apr. 23, 2019, now abandoned.

(60) Provisional application No. 62/661,524, filed on Apr. 23, 2018.

(51) Int. Cl.
*C12N 9/02* (2006.01)

(52) U.S. Cl.
CPC .... *C12N 9/0004* (2013.01); *C12Y 121/03007* (2015.07)

(58) Field of Classification Search
None
See application file for complete search history.

(56) References Cited

U.S. PATENT DOCUMENTS

| | | | |
|---|---|---|---|
| 9,861,609 B2 | 1/2018 | Winnicki et al. | |
| 2016/0053220 A1* | 2/2016 | Peet .................. | C12M 41/48 435/289.1 |
| 2017/0211049 A1 | 7/2017 | Page et al. | |
| 2018/0320209 A1 | 11/2018 | Rudenko et al. | |
| 2018/0334692 A1 | 11/2018 | Barr et al. | |
| 2019/0185946 A1 | 6/2019 | McKernan | |
| 2021/0238561 A1 | 8/2021 | Botsch et al. | |
| 2022/0364066 A1 | 11/2022 | Botsch et al. | |

FOREIGN PATENT DOCUMENTS

| | | |
|---|---|---|
| WO | WO-2019173770 A1 | 9/2019 |
| WO | WO-2019209885 A2 | 10/2019 |
| WO | WO-2019209885 A3 | 1/2020 |
| WO | WO-2021081246 A1 | 4/2021 |

OTHER PUBLICATIONS

Shoyama et al. J Mol Biol. 423(1):96-105, 2012 (Year: 2012).*
Chica et al. Curr Opin Biotechnol. Aug. 2005;16(4):378-84. (Year: 2005).*
Singh et al. Curr Protein Pept Sci. 2017, 18, 1-11 (Year: 2017).*
Bornscheuer et al. Curr Protoc Protein Sci. Nov. 2011;Chapter 26:Unit26.7. (Year: 2011).*
Yoshikuni et al. Curr Opin Chem Biol. Apr. 2007;11(2):233-9. (Year: 2007).*
Accession A6P6V9. Aug. 21, 2007. (Year: 2007).*
Accession A0A0E3TIL8. Jun. 24, 2015. (Year: 2015).*
Kojoma et al., DNA polymorphisms in the tetrahydrocannabinolic acid (THCA) synthase gene in "drug-type" and "fiber-type" Cannabis sativa L. Forensic Sci Int 159(2-3):132-140 (2006).
Degenhardt, F., et al., "Chapter 2—The Biosynthesis of Cannabinoids", Handbook of Cannabis and Related Pathologies, 2017, Editor(s): V.R. Preedy, Academic Press, pp. 13-23.
Needleman, S.B. et al., "A General Method Applicable to the Search for Similarities in the Amino Acid Sequence of Two Proteins", J. Mol. Biol., 1970, 48, 443-453.
PCT/US2019/028806 International Preliminary Report on Patentability dated Oct. 27, 2020.
PCT/US2019/028806 International Search Report and Written Opinion dated Dec. 2, 2019.
PCT/US2020/056916 International Preliminary Report on Patentability dated Apr. 26, 2022.
PCT/US2020/056916 International Search Report and Written Opinion dated Feb. 10, 2021.
U.S. Appl. No. 17/049,822 Office Action dated Jan. 21, 2022.
Zirpel et al., Elucidation of structure-function relationship of THCA and CBDA synthase from *Cannabis sativa*L. J Biotechnol. 284:17-26 (2018).

* cited by examiner

*Primary Examiner* — Christian L Fronda
(74) *Attorney, Agent, or Firm* — WILSON SONSINI GOODRICH & ROSATI

(57) ABSTRACT

Described herein are variant, novel cannabinoid synthases, nucleic acids encoding same, and various uses thereof.

20 Claims, 18 Drawing Sheets

Specification includes a Sequence Listing.

```
                              10        20        30        40        50        60        70        80
                        ....|....|....|....|....|....|....|....|....|....|....|....|....|....|....|....|
CBDA_E55107.1           MKCSTFSFWFVCKIIFFFFSFNIQTSIANPRENFLKCFSQYIPNNATNLKLVYTQNNPLYMSVLNSTIHNLRFTSDTTPK
CBDAS_AA_consensus      .----fslkallplalllvsanqvaakv...................................................
THCAS_E33090.1          .N..A...........L..H..I..........KH....VA.P........HDQ....I.....Q....I.........
CBCAS_JP2016            .N..............L.....I.....Q........E.....PA.P.FI...HDQ.........Q.............
                         ◊◊◊◊◊◊◊◊◊◊◊◊◊◊◊◊◊◊◊◊◊◊◊◊◊◊

90       100       110       120       130       140       150       160
                        ....|....|....|....|....|....|....|....|....|....|....|....|....|....|....|....|
CBDA_E55107.1           PLVIVTPSHVSHIQGTILCSKKVGLQIRTRSGGHDSEGMSYISQVPFVIVDLRNMRSIKIDVHSQTAWVEAGATLGEVYY
CBDAS_AA_consensus      ................................................................................
THCAS_E33090.1          ........NN....A...................A...........V.....H.........................
CBCAS_JP2016            ........N.....AS..................A..L........A.......HTV.V.I..................

170       180       190       200       210       220       230       240
                        ....|....|....|....|....|....|....|....|....|....|....|....|....|....|....|....|
CBDA_E55107.1           WVNEKNENLSLAAGYCPTVCAGGHFGGGGYGPLMRNYGLAADNIIDAHLVNVHGKVLDRKSMGEDLFWALRGGGAESFGI
CBDAS_AA_consensus      ................................................................................
THCAS_E33090.1          .I......FPG.....GV....S....A.............D..................I....G.N...
CBCAS_JP2016            .I..M...F.FPG...GV....S.....A.............D..................I....G.N...

250       260       270       280       290       300       310       320
                        ....|....|....|....|....|....|....|....|....|....|....|....|....|....|....|....|
CBDA_E55107.1           IVAWKIRLVAVP-KSTMFSVKKIMEIHELVKLVNKWQNIAYKYDKDLLLMTHFITRNITDNQGKNKTAIHTYFSSVFLGG
CBDAS_AA_consensus      ............-...................................................................
THCAS_E33090.1          .A.....K....S...I......N....G....F......V........K.....H.....TV.G....I.H..
CBCAS_JP2016            .A.C...K...V..S.A.I.....N....G....F......M.T...R.......H.....TV.G....I....

330       340       350       360       370       380       390       400
                        ....|....|....|....|....|....|....|....|....|....|....|....|....|....|....|....|
CBDA_E55107.1           VDSLVDLMNKSFPELGIKKTDCRQLSWIDTIIFYSGVVNYDTDNFNKEILLDRSAGQKGAFKIKLDYVKKPIPESVFVQI
CBDAS_AA_consensus      ................................................................................
THCAS_E33090.1          ....................KEF.....T........FN..A...K......KKT..S...........TAM.K.
CBCAS_JP2016            ....................KE......T........N..A...K......KKT..S.........L...TAM.K.

410       420       430       440       450       460       470       480
                        ....|....|....|....|....|....|....|....|....|....|....|....|....|....|....|....|
CBDA_E55107.1           LEKLYEEDIGAGMYALYPYGGIMDEISESAIPFPHRAGILYELWYICSWEKQEDNEKHLNWIRNIYNFMTPYVSKNPRLA
CBDAS_AA_consensus      ................................................................................
THCAS_E33090.1          .......V.....V........E............M.....TA..........I..V.SV...T.....Q.....
CBCAS_JP2016            .......EV.V...V...............M.....TAT..........I..V.SV...T.....Q.....

490       500       510       520       530       540       550
                        ....|....|....|....|....|....|....|....|....|....|....|....|....|....|....|.
CBDA_E55107.1           YLNYRDLDIGINDPKNPNNYTQARIWGEKYFGKNFDRLVKVKTLVDPNNFFRNEQSIPPLPRHRH*~~~~~
CBDAS_AA_consensus      ...............................................................HHHHH*
THCAS_E33090.1          ........L.KTNHAS.................N.......K.................P.H.~~~~~
CBCAS_JP2016            ........L.KTN.ES.................N.......KA................PRH.~~~~~
```

| CBDA_E55107 | NRQYALVVTVTMVISIIVKLASLMIRLLYPDADSPKV |
|---|---|
| AB212834.1_Kojoma_013 | H.KHV..IIN...V........V..KHFF...E.HA. |
| AB212835.1_Kojoma_020 | H.KHV..IIN...V........V..KHFF...E.HA. |
| AB212838.1_Kojoma_054 | H.KHV..IIN...V........V..KHFF...E.HA. |
| AB212829.1_Kojoma_001 | H.KHV..LIN...V........V..KHFF...E.HA. |
| AB212837.1_Kojoma_053 | H.KHV..IIN...V........V..KHFF...E.HA. |
| AB212832.1_Kojoma_010 | H.KHV..IIN...V........V..KHFF...E.HA. |
| THCA_E33090 | H.KHV..IIN...V........V..KHFF...E.HA. |

| CBCA_JP_2016 | .QE.PFI...SLA.TVVIMFVAMTR....LEV.T.EA |
|---|---|
| AB212830.1_cKojoma_005 | .QE.PFI...SLA.TVVIMFVAMTR....LEV.T.EA |
| AB212831.1_cKojoma_009 | .QE.PFI...SLA.TVVIMFVAMTR....LEV.T.EA |
| AB212833.1_cKojoma_011 | .QE.PFI...SLA.TVVIMFVAMTR....LEV.T.EA |
| AB212836.1_cKojoma_045 | .QE.PFI...SLA.TVVIMFVAMTR....LEV.T.EA |
| AB212840.1_cKojoma_068 | .QE.PFI...SLA.TVVIMFVAMTR....LEV.T.EA |
| AB212841.1_cKojoma_078 | .QE.PFI...SLA.TVVIMFVAMTR....LEV.T.EA |
| AB212839.1_cKojoma_066 | .QE.PFI...SLA.TVVIMFVAMTR....LEV.T.EA |

FIG. 3

```
                            10        20        30        40        50        60        70        80
                       ....|....|....|....|....|....|....|....|....|....|....|....|....|....|....|....|
CBDAS_DNA_consensus    ATGTTCTCTTTAAAGGCTTTATTGCCTTTGGCTTTATTATTAGTCTCTGCTAACCAAGTCGCTGCTAAAGTAAACCCAAG
                        M  F  S  L  K  A  L  L  P  L  A  L  L  V  S  A  N  Q  V  A  A  K  V  N  P  R 90       100       110       120       130       140       150       160
                       ....|....|....|....|....|....|....|....|....|....|....|....|....|....|....|....|
CBDAS_DNA_consensus    AGAAAACTTTTTGAAATGTTTTTCTCAATATATCCCTAACAATGCTACTAATTTGAAGTTAGTTTACACTCAAAATAACC
                        E  N  F  L  K  C  F  S  Q  Y  I  P  N  N  A  T  N  L  K  L  V  Y  T  Q  N  N 170       180       190       200       210       220       230       240
                       ....|....|....|....|....|....|....|....|....|....|....|....|....|....|....|....|
CBDAS_DNA_consensus    CATTGTATATGTCAGTCTTAAACTCAACCATTCACAATTTAAGATTTACTTCTGACACTACCCCAAAACCATTAGTCATT
                        P  L  Y  M  S  V  L  N  S  T  I  N  L  R  F  T  S  D  T  T  P  K  P  L  V  I 250       260       270       280       290       300       310       320
                       ....|....|....|....|....|....|....|....|....|....|....|....|....|....|....|....|
CBDAS_DNA_consensus    GTCACACCTTCACACGTTTCTCATATTCAAGGAACTATATTATGTTCTAAAAGGTGGTTTGCAAATTAGGACAAGATC
                        V  T  P  S  H  V  S  H  I  Q  G  T  I  L  C  S  K  K  V  G  L  Q  I  R  T  R  S 330       340       350       360       370       380       390       400
                       ....|....|....|....|....|....|....|....|....|....|....|....|....|....|....|....|
CBDAS_DNA_consensus    AGGTGGTCACGACTCTGAAGGTATGTCTTATATCTCACAAGTACCATTCGTCATAGTAGATTTGAGAAATATGAGATCAA
                         G  G  H  D  S  E  G  M  S  Y  I  S  Q  V  P  F  V  I  V  D  L  R  N  M  R  S 410       420       430       440       450       460       470       480
                       ....|....|....|....|....|....|....|....|....|....|....|....|....|....|....|....|
CBDAS_DNA_consensus    TTAAGATTGATGTTCATTCTCAGACAGCCTGGGTAGAAGCCGGTGCTACTTTAGGAGAAGTTTACTATTGGGTTAATGAG
                        I  K  I  D  V  H  S  Q  T  A  W  V  E  A  G  A  T  L  G  E  V  Y  Y  W  V  N  E 490       500       510       520       530       540       550       560
                       ....|....|....|....|....|....|....|....|....|....|....|....|....|....|....|....|
CBDAS_DNA_consensus    AAGAACGAGAACTTGTCATTAGCAGCAGGTTACTGCCCAACCGTATGTGCTGGTGGTCATTTTGGTGGTGGTGGATATGG
                        K  N  E  N  L  S  L  A  A  G  Y  C  P  T  V  C  A  G  G  H  F  G  G  G  G  Y  G 570       580       590       600       610       620       630       640
                       ....|....|....|....|....|....|....|....|....|....|....|....|....|....|....|....|
CBDAS_DNA_consensus    ACCTTTGATGAGGAATTATGGTTTGGCTGCTGATAACATTATAGATGCTCACTTAGTTAATGTTCACGGTAAGGTCTTAG
                        P  L  M  R  N  Y  G  L  A  A  D  N  I  I  D  A  H  L  V  N  V  H  G  K  V  L 650       660       670       680       690       700       710       720
                       ....|....|....|....|....|....|....|....|....|....|....|....|....|....|....|....|
CBDAS_DNA_consensus    ACAGGAAGTCTATGGGAGAAGATTTGTTTTGGGCATTGAGGGGAGGTGGTGCAGAGTCTTTCGGTATAATCGTTGCCTGG
                        D  R  K  S  M  G  E  D  L  F  W  A  L  R  G  G  A  E  S  F  G  I  I  V  A  W 730       740       750       760       770       780       790       800
                       ....|....|....|....|....|....|....|....|....|....|....|....|....|....|....|....|
CBDAS_DNA_consensus    AAGATTAGGTTGGTTGCTGTTCCAAAATCAACAATGTTTTCTGTTAAGAAGATAATGGAAATCCATGAGTTGGTTAAATT
                        K  I  R  L  V  A  V  P  K  S  T  M  F  S  V  K  K  I  M  E  T  H  E  L  V  K  L 810       820       830       840       850       860       870       880
                       ....|....|....|....|....|....|....|....|....|....|....|....|....|....|....|....|
CBDAS_DNA_consensus    GGTTAATAAGTGGCAAAACATCGCCTATAAGTACGACAAAGACTTATTGTTGATGACACATTTTATTACTAGGAACATTA
                        V  N  K  W  Q  N  I  A  Y  K  Y  D  K  D  L  L  L  M  T  H  F  I  T  R  N  I 890       900       910       920       930       940       950       960
                       ....|....|....|....|....|....|....|....|....|....|....|....|....|....|....|....|
CBDAS_DNA_consensus    CAGATAATCAAGGTAAAAACAAAACTGCTATACATACCTACTTCTCTTCTGTATTCTTGGGAGGTGTCGATTCATTGGTT
                        T  D  N  Q  G  K  N  K  T  A  I  H  T  Y  F  S  S  V  F  L  G  G  V  D  S  L  V 970       980       990      1000      1010      1020      1030      1040
                       ....|....|....|....|....|....|....|....|....|....|....|....|....|....|....|....|
CBDAS_DNA_consensus    GATTTAATGAATAAATCTTTTCCTGAGTTGGGAATAAAAAAAACTGATTGCAGACAATTGTCATGGATTGATACAATTAT
                        D  L  M  N  K  S  F  P  E  L  G  I  K  K  T  D  C  R  Q  L  S  W  I  D  T  I  T
```

FIG. 6

```
                        1050      1060      1070      1080      1090      1100      1110      1120
                   ....|....|....|....|....|....|....|....|....|....|....|....|....|....|....|....|
CBDAS_DNA_consensus ATTTTATTCAGGAGTTGTCAACTATGACACTGATAACTTTAATAAAGAAATCTTGTTGGACAGGTCAGCCGGTCAAAATG
                    F  Y  S  G  V  V  N  Y  D  T  D  N  F  N  K  E  I  L  L  D  R  S  A  G  Q  N 1130      1140      1150      1160      1170      1180      1190      1200
                   ....|....|....|....|....|....|....|....|....|....|....|....|....|....|....|....|
CBDAS_DNA_consensus GAGCCTTCAAGATAAAATTGGATTATGTTAAGAAACCAATTCCAGAATCAGTATTTGTCCAGATTTTGGAAAAATTATAT
                    G  A  F  K  I  K  L  D  Y  V  K  K  P  I  P  E  S  V  F  V  Q  I  L  E  K  L  Y 1210      1220      1230      1240      1250      1260      1270      1280
                   ....|....|....|....|....|....|....|....|....|....|....|....|....|....|....|....|
CBDAS_DNA_consensus GAAGAAGATATAGGTGCAGGTATGTATGCCTTATACCCTTATGGTGGTATTATGGACGAAATATCTGAATCAGCTATACC
                    E  E  D  I  G  A  G  M  Y  A  L  Y  P  Y  G  G  I  M  D  E  I  S  E  S  A  I  P 1290      1300      1310      1320      1330      1340      1350      1360
                   ....|....|....|....|....|....|....|....|....|....|....|....|....|....|....|....|
CBDAS_DNA_consensus TTTTCCACATAGAGCTGGTATATTATATGAATTGTGGTACATCTGTTCTTGGGAGAAACAAGAGGATAATGAGAAGCACT
                    F  P  H  R  A  G  I  L  Y  E  L  W  Y  I  C  S  W  E  K  Q  E  D  N  E  K  H 1370      1380      1390      1400      1410      1420      1430      1440
                   ....|....|....|....|....|....|....|....|....|....|....|....|....|....|....|....|
CBDAS_DNA_consensus TAAATTGGATAAGAAATATCTATAATTTTATGACACCATACGTTTCTAAGAACCCTAGATTGGCATACTTGAATTACAGA
                    L  N  W  I  R  N  Y  Y  N  F  M  T  P  Y  V  S  K  N  P  R  L  A  Y  L  N  Y  R 1450      1460      1470      1480      1490      1500      1510      1520
                   ....|....|....|....|....|....|....|....|....|....|....|....|....|....|....|....|
CBDAS_DNA_consensus GACTTGGATATTGGAATTAACGATCCTAAAAACCCTAATAATTATACACAAGCTAGGATTTGGGGTGAAAAATACTTCGG
                    D  L  D  I  G  I  N  D  P  K  N  P  N  N  Y  T  Q  A  R  I  W  G  E  K  Y  F  G 1530      1540      1550      1560      1570      1580      1590      1600
                   ....|....|....|....|....|....|....|....|....|....|....|....|....|....|....|....|
CBDAS_DNA_consensus TAAGAACTTTGATAGATTAGTTAAGGTTAAAACTTTAGTAGATCCAAATAATTTTTTCAGAAATGAGCAATCAATTCCAC
                    K  N  F  D  R  L  V  K  V  K  T  L  V  D  P  N  N  F  F  R  N  E  Q  S  I  P 1610      1620      1630
                   ....|....|....|....|....|....|....|...
CBDAS_DNA_consensus CATTACCAAGACACAGACACCaccaccaccaccactaa
                    P  L  P  R  H  R  H  H  H  H  H  H  *
```

FIG. 6 (cont'd)

```
                             10         20         30         40         50         60         70         80
                    ....|....|....|....|....|....|....|....|....|....|....|....|....|....|....|....|
THCAS_DNA_consensus ATGTTCTCTTTAAAGGCTTTATTGCCTTTGGCTTTATTATTAGTCTCTGCTAACCAAGTCGCTGCTAAAGTAAATCCAAG 90        100        110        120        130        140        150        160
                    ....|....|....|....|....|....|....|....|....|....|....|....|....|....|....|....|
THCAS_DNA_consensus AGAGAACTTCTTAAAATGTTTCTCAAAGCATATTCCAAATAATGTTGCAAACCCTAAGTTAGTCTATACACAACATGACC 170        180        190        200        210        220        230        240
                    ....|....|....|....|....|....|....|....|....|....|....|....|....|....|....|....|
THCAS_DNA_consensus AATTGTATATGTCAATCTTGAACTCAACAATACAAAACTTGAGATTTATCTCAGATACTACACCTAAACCATTAGTCATA 250        260        270        280        290        300        310        320
                    ....|....|....|....|....|....|....|....|....|....|....|....|....|....|....|....|
THCAS_DNA_consensus GTAACTCCTTCTAATAATTCTCACATACAAGCTACAATTTTATGTTCAAAAAAAGTCGGTTTGCAGATTAGAACAAGGTC 330        340        350        360        370        380        390        400
                    ....|....|....|....|....|....|....|....|....|....|....|....|....|....|....|....|
THCAS_DNA_consensus AGGAGGTCACGACGCTGAGGGTATGTCTTATATCTCACAAGTCCCATTCGTTGTCGTCGATTTGAGAAATATGCACTCAA 410        420        430        440        450        460        470        480
                    ....|....|....|....|....|....|....|....|....|....|....|....|....|....|....|....|
THCAS_DNA_consensus TAAAAATAGACGTTCATTCACAGACAGCTTGGGTTGAAGCCGGAGCCACATTAGGTGAGGTCTATTACTGGATAAATGAG 490        500        510        520        530        540        550        560
                    ....|....|....|....|....|....|....|....|....|....|....|....|....|....|....|....|
THCAS_DNA_consensus AAAAATGAAAACTTGTCTTTTCCTGGAGGATACTGTCCTACCGTAGGTGTAGGTGGTCATTTTTCTGGTGGTGGATATGG 570        580        590        600        610        620        630        640
                    ....|....|....|....|....|....|....|....|....|....|....|....|....|....|....|....|
THCAS_DNA_consensus AGCCTTAATGAGAAACTATGGTTTGGCAGCCGACAACATCATTGACGCACACTTGGTCAATGTTGATGGTAAAGTCTTAG 650        660        670        680        690        700        710        720
                    ....|....|....|....|....|....|....|....|....|....|....|....|....|....|....|....|
THCAS_DNA_consensus ATAGAAAATCAATGGGTGAAGATTTATTTTGGGCAATAAGAGGTGGAGGAGGTGAGAACTTGGTATTATCGCTGCTTGG 730        740        750        760        770        780        790        800
                    ....|....|....|....|....|....|....|....|....|....|....|....|....|....|....|....|
THCAS_DNA_consensus AAGATCAAGTTGGTTGCAGTACCTTCTAAGTCAACTATATTCTCAGTTAAAAAGAACATGGAAATACATGGTTTGGTTAA 810        820        830        840        850        860        870        880
                    ....|....|....|....|....|....|....|....|....|....|....|....|....|....|....|....|
THCAS_DNA_consensus ATTATTCAATAAGTGGCAAAACATCGCATACAAATACGACAAGGACTTAGTCTTAATGACTCATTTTATTACTAAGAACA 890        900        910        920        930        940        950        960
                    ....|....|....|....|....|....|....|....|....|....|....|....|....|....|....|....|
THCAS_DNA_consensus TTACAGATAATCACGGTAAAAACAAAACAACAGTACACGGATATTTTCTTCTATTTTTCATGGAGGTGTTGATTCATTA 970        980        990       1000       1010       1020       1030       1040
                    ....|....|....|....|....|....|....|....|....|....|....|....|....|....|....|....|
THCAS_DNA_consensus GTCGATTTGATGAATAAATCATTTCCTGAGTTAGGTATTAAAAAGACAGATTGTAAAGAGTTCTCTGGATAGACACTAC 1050       1060       1070       1080       1090       1100       1110       1120
                    ....|....|....|....|....|....|....|....|....|....|....|....|....|....|....|....|
THCAS_DNA_consensus CATATTTTATTCTGGTGTTGTCAACTTCAATACCGCCAACTTCAAAAAGGAGATTTGTTGGATAGATCAGCCGGAAAAA 1130       1140       1150       1160       1170       1180       1190       1200
                    ....|....|....|....|....|....|....|....|....|....|....|....|....|....|....|....|
THCAS_DNA_consensus AGACAGCCTTCTCTATCAAGTTGGACTACGTCAAGAAACCAATTCCTGAGACTGCTATGGTTAAGATTTTAGAGAAATTG 1210       1220       1230       1240       1250       1260       1270       1280
                    ....|....|....|....|....|....|....|....|....|....|....|....|....|....|....|....|
THCAS_DNA_consensus TATGAAGAGGACGTAGGAGCAGGTATGTACGTTTTGTATCCTTACGGTGGAATTATGGAAGAAATCTCTGAATCTGCCAT 1290       1300       1310       1320       1330       1340       1350       1360
                    ....|....|....|....|....|....|....|....|....|....|....|....|....|....|....|....|
THCAS_DNA_consensus TCCTTTCCCTCATAGAGCAGGTATCATGTATGAATTGTGGTACACTGCCTCTTGGGAAAAACAAGAAGATAATGAGAAAC 1370       1380       1390       1400       1410       1420       1430       1440
                    ....|....|....|....|....|....|....|....|....|....|....|....|....|....|....|....|
THCAS_DNA_consensus ACATAAACTGGGTCAGATCAGTTTACAACTTTACCACACCTTATGTATCTCAAAACCCTAGATTGGCATACTTGAACTAC 1450       1460       1470       1480       1490       1500       1510       1520
                    ....|....|....|....|....|....|....|....|....|....|....|....|....|....|....|....|
THCAS_DNA_consensus AGAGATTTGGATTTGGGTAAAAACCAACCACGCATCACCTAACAACTATACTCAGGCAAGAATATGGGGAGAAAAATACTT 1530       1540       1550       1560       1570       1580       1590       1600
                    ....|....|....|....|....|....|....|....|....|....|....|....|....|....|....|....|
THCAS_DNA_consensus CGGTAAAAACTTCAATAGATTAGTCAAAGTAAAGACTAAAGTTGATCCTAACAATTTTTTTAGAAATGAACAATCTATCC 1610       1620       1630
                    ....|....|....|....|....|....|....|
THCAS_DNA_consensus CACCTTTGCCACCTCACCATCACcaccaccactaa
```

FIG. 7

VARIANT CANNABINOID SYNTHASES AND METHODS AND USES THEREOF

CROSS-REFERENCE TO RELATED APPLICATIONS

This application is a continuation of U.S. patent application Ser. No. 17/049,822, filed Oct. 22, 2020, which is a national stage entry of International Application No. PCT/US2019/028806, filed Apr. 23, 2019, which claims the benefit of U.S. Provisional Application No. 62/661,524 filed Apr. 23, 2018 which is incorporated herein by reference.

SEQUENCE LISTING

The instant application contains a Sequence Listing which has been submitted electronically in XML file format and is hereby incorporated by reference in its entirety. Said XML copy, created on Sep. 25, 2023, is named 56397-701_301SL.xml and is 2,358,730 bytes in size.

BACKGROUND

Field of the Invention

The present disclosure relates to enzyme engineering to produce variant cannabinoid synthases.

Related Art

Cannabinoids are terpenophenolic secondary metabolites, produced by *Cannabis sativa* (*C. sativa*) plants in the sessile and stalked trichomes. The steps involved in the biosynthesis of the different cannabinoids from the common precursor have been largely elucidated. According to this widely accepted pathway, cannabigerolic acid (CBGA) is the first cannabinoid produced in the *C. sativa* cannabinoid biosynthesis pathway, formed through the condensation of a phenolic moiety (e.g. olivetolic or divarinic acid) with the terpenoid component, geranyl pyrophosphate (GPP). CBGA and its alkyl homologs are considered as the common precursors of all the main cannabinoids produced through an enzyme activity by the plant: i.e. the alkyl homologs of delta 9-tetrahydrocannabinolic acid (THCA), cannabidiolic acid (CBDA) and cannabichromenic acid (CBCA). All the CBGA alkyl-homologs can be used as substrate and transformed by plant extracts containing the different cannabinoid synthases in vitro, although the efficiency of conversion was known to be different for each homolog. The different synthases catalyzing the oxidocyclization of CBGA into THCA, CBDA or CBCA (and their alkyl homologs), have been characterized in recent years. THCA-synthase (THCAS) and CBDA-synthase (CBDAS) share many similarities in their biochemical properties, such as their protein mass (they are monomeric proteins, approximately 74 kDa absent post-translational modification), pI, Vmax and Km for CBGA (while cannabichromenic acid synthase has less information in public databases). They are both soluble enzymes with ~84% sequence identity at the amino acid level (comparison based on GenBank accession numbers E55107 and E33090). Both have a 28-amino-acids putative signal peptide that is removed during maturation in the plant, and a FAD-binding domain. The tertiary structure of THCAS was recently resolved and amino-acid positions putatively involved in flavin adenine dinucleotide (FAD) and substrate binding were identified by X-ray crystallography to a 2.75 Å resolution and also by mutational analysis.

Natural sequence variants of THCAS and CBDAS have been isolated from different *C. sativa* strains and were shown to have different specificity and/or ability to convert the precursor CBGA into CBDA and THCA (and other products). The amount of nucleotide (and amino acid) diversity was found to be higher within the CBDAS sequence family than in the THCAS family. It is therefore believed that CBDAS is the ancestral type of these synthases.

Although natural products continue to provide about half of all new chemical entities approved as drugs by the US Food and Drug Administration, industry efforts for drug discovery during the latter part of the 20th century shifted away from exploring natural products and instead shifted towards screening synthetic libraries. This paradigm shift reflected the complexity of small, natural libraries against the simplicity of large, combinatorial synthetic libraries and was rationalized to accommodate the enormous capacity of industrial high-throughput screening programs. The putative promised plethora of new drugs from combinatorial chemical libraries, however, did not materialize during this time period, while natural products continued to prove an important source of drug targets. Natural products likes phytocannabinoids that can accent the endocannabinoids pathway in humans could serve as new drugs, represent a chemical space that those combinatorial compound libraries have not been able to tap into; and natural phytocannabinoids have already shown powerful biology by activating cell receptors throughout the human body and are capable of passing the blood-brain.

Plant derived cannabinoids (phytocannabinoids) from *C. sativa* consist of a large family of over 100 natural molecules that happen to interact with normal cell receptors throughout the human body (endocannabinoid receptors) and are capable of passing the blood-brain barrier to interact with receptors in the brain. Only a few of these phytocannabinoids are psychoactive (such as Δ9-THC, a.k.a. THC), while many phytocannabinoids are not psychoactive. The cannabinoid Δ9-tetrahydrocannabinol (Δ9-THC) is made in large quantities in *C. sativa* and has been well studied for its interaction with receptors in the brain. Medical research on non-psychoactive phytocannabinoids suggest that these molecules have medicinal properties however many of these (aside from CBD) are produced by the plant at very low levels (i.e. "non-abundant cannabinoids"). These desirable non-abundant cannabinoids are not easily separated into pure forms after extraction from the plant (*C. sativa*), and so obtaining these non-abundant cannabinoids in industrial pure forms is often cost prohibitive. The different native cannabinoid synthases to *C. sativa* that catalyze the oxidocyclization of CBGA (and their alkyl homologs), into THCA, CBDA or CBCA have been characterized in recent years have proven to be difficult to express exogenously.

Because wild type cannabinoid synthases have various limitations, there is a need for novel cannabinoid synthases, systems, and methods of use that overcomes these limitations.

SUMMARY

Described herein, in certain embodiments, are variant cannabinoid synthases or active fragments thereof comprising a non-naturally occurring amino acid sequence relative to a wild-type cannabinoid synthase or an active fragment thereof which acts on a substrate to produce an altered amount of a cannabinoid relative to an amount of the cannabinoid produced by the wild-type cannabinoid synthase or active fragment thereof. In some embodiments, the variant cannabinoid synthase is a variant cannabidiolic acid (CBDA) synthase comprising a non-naturally occurring amino acid sequence relative to a wild type CBDA synthase of SEQ ID NO: 1043. In some embodiments, the variant cannabinoid synthase is a variant cannabidiolic acid (CBDA) synthase comprising a non-naturally occurring amino acid sequence relative to a wild type consensus CBDA synthase of SEQ ID NO: 1046. In some embodiments, the variant cannabinoid synthase is a tetrahydrocannabinolic acid (THCA) synthase comprising a non-naturally occurring amino acid sequence relative to a wild type THCA synthase of SEQ ID NO: 1044. In some embodiments, the variant cannabinoid synthase is a tetrahydrocannabinolic acid (THCA) synthase comprising a non-naturally occurring amino acid sequence relative to a wild type consensus THCA synthase of SEQ ID NO: 1047. In some embodiments, the variant cannabinoid synthase is a cannabichromenic acid (CBCA) synthase comprising a non-naturally occurring amino acid sequence relative to a wild type CBCA synthase of SEQ ID NO: 1045. In some embodiments, the variant cannabinoid synthase is a cannabichromenic acid (CBCA) synthase comprising a non-naturally occurring amino acid sequence relative to a wild type consensus CBCA synthase of SEQ ID NO: 1048.

In some embodiments, the cannabinoid is selected from the group consisting of: tetrahydrocannabinolic acid (THCA), tetrahydrocannabinol (THC), tetrahydrocannabinvarin (THCV), cannabidiolic acid (CBDA), cannabidiol (CBD), cannabidivarin (CBDV), cannabichromene (CBC), cannabichromevarin (CBCV), cannabichromenic acid (CBCA), and a combination thereof. In some embodiments, the substrate is a naturally occurring substrate. In some embodiments, the naturally occurring substrate is selected from the group consisting of cannabigerol (CBG), cannabigerolic acid (CBGA), cannbigerovarinic acid (GBGVA), and any homolog thereof. In some embodiments, the substrate is a non-naturally occurring substrate. In some embodiments, the non-naturally occurring substrate can comprise: a non-naturally occurring tail variant, a prenyl donor, or a combination thereof.

In some embodiments, the altered amount of the cannabinoid produces a change in a proportion of a first cannabinoid to a second cannabinoid. In some embodiments, the variant cannabinoid synthase is a variant CBDA synthase. In some embodiments, the first cannabinoid is CBDA and the second cannabinoid is THCA. In some embodiments, a proportion of CBDA:THCA produced by a wild type CBDA synthase is about 95:5. In some embodiments, the non-naturally occurring amino acid sequence comprises an amino acid mutation at position 445 relative to a wild-type consensus CBDA synthase amino acid sequence set forth in SEQ ID NO: 1046. In some embodiments, the amino acid mutation at position 445 is selected from the group consisting of: I445M and I445L. In some embodiments, the altered amount of the cannabinoid is an increase or a decrease in a yield of the cannabinoid. In some embodiments, the yield is a nMol of the cannabinoid produced per milligram of the substrate. In some embodiments, the decrease in the yield is less than 100%, less than 200%, or less than 300% of a yield of the cannabinoid of the wild-type cannabinoid synthase or active fragment thereof. In some embodiments, the increase in the yield is more than 100%, more than 200%, or more than 300% of a yield of the cannabinoid of the wild-type cannabinoid synthase or active fragment thereof. In some embodiments, the variant cannabinoid synthase is a variant CBDA synthase.

In some embodiments, the non-naturally occurring amino acid sequence comprises at least one amino acid mutation at position 69, 414, or 445 relative to a wild-type consensus CBDA synthase amino acid sequence set forth in SEQ ID NO: 1046. In some embodiments, the at least one amino acid mutation at position 69 is selected from the group consisting of: H69R, H69G, H69K, H69Q, H69A, and H69V. In some embodiments, the at least one amino acid mutation at position 414 is selected from the group consisting of: A414T, A414I, and A414V. In some embodiments, the at least one amino acid mutation at position 445 is I445V.

In some embodiments, the non-naturally occurring amino acid sequence comprises at least two amino acid mutations at positions selected from the group consisting of: 69, 180, 414, and 445 relative to a wild-type consensus CBDA synthase amino acid sequence set forth in SEQ ID NO: 1046. In some embodiments, one of the at least two amino acid mutations is at amino acid position 69. In some embodiments, one of the at least two amino acid mutations at amino acid position 69 is selected from the group consisting of H69A, H69C, H69D, H69E, H69F, H69G, H69I, H69K, H69L, H69M, H69N, H69P, H69Q, H69R, H69S, H69T, H69V, H69W, and H69Y. In some embodiments, one of the at least two amino acid mutations at amino acid position 69 is selected from the group consisting of H69K, H69Q, H69V, and H69G. In some embodiments, one of the at least two amino acid mutations is at amino acid position 180. In some embodiments, one of the at least two amino acid mutations at amino acid position 180 is selected from the group consisting of C180A, C180D, C180E, C180F, C180G, C180H, C180I, C180K, C180L, C180M, C180N, C180P, C180Q, C180R, C180S, C180T, C180V, C180W, and C180Y. In some embodiments, one of the at least two amino acid mutations is at amino acid position 414. In some embodiments, one of the at least two amino acid mutations at amino acid position 414 is selected from the group consisting of A414C, A414D, A414E, A414F, A414G, A414H, A414I, A414K, A414L, A414M, A414N, A414P, A414Q, A414R, A414S, A414T, A414V, A414W, and A414Y. In some embodiments, one of the at least two amino acid mutations at amino acid position 414 is selected from the group consisting of: A414V and A414I. In some embodiments, one of the at least two amino acid mutations is at amino acid position 445. In some embodiments, one of the at least two amino acid mutations at amino acid position 445 is selected from the group consisting of I445A, I445C, I445D, I445E, I445F, I445G, I445H, I445K, I445L, I445M, I445N, I445P, I445Q, I445R, I445S, I445T, I445V, I445W, and I445Y. In some embodiments, one of the at least two amino acid mutations at amino acid position 445 is I445M. In some embodiments, the at least two amino acid mutations are at a pair of positions selected from the group consisting of: 69/180, 69/414, 69/445, 180/414, 180/445, and 414/445. In some embodiments, the at least two amino acid mutations are selected from the group consisting of: A414V/H69K, A414V/H69Q, A414V/H69V, A414V/H69G, A414V/I44M, A414I/H69K, I445M/H69K, and I445M/H69Q. In some embodiments, the non-naturally occurring amino acid sequence comprises at least three amino acid mutations at positions selected from the group consisting of: 69, 180, 414, and 445 relative to a wild-type consensus CBDA synthase amino acid sequence set forth in SEQ ID NO: 1046. In some embodiments, the at least three amino acid mutations are at a triple of positions selected from the group consisting of: 69/180/441, 69/180/445, 69/414/445, and 180/414/445. In some embodiments, the at least three amino acid mutations are H69Q/A414V/I445M. Disclosed herein, in certain embodiments, are variant cannabidiolic acid (CBDA) synthases or active fragments thereof comprising an amino acid mutation at a position selected from the group consisting of: 69, 414, 180, and 445 relative to a wild-type consensus CBDA synthase set forth in SEQ ID NO: 1046.

In some embodiments, a mutation at amino acid position 69 is selected from the group consisting of: H69R, H69G, H69K, H69Q, H69A, and H69V. In some embodiments, the mutation at amino acid position 69 results in the variant CBDA synthase producing an increase yield of a CBDA relative to a wild type CBDA synthase or active fragment thereof. In some embodiments, the yield of the variant or active fragment thereof is more than 100%, more than 200%, or more than 300% of a yield of CBDA of the wild-type CBDA synthase or active fragment thereof. In some embodiments, the yield is a nMol of CBDA produced per milligram of a substrate. In some embodiments, the substrate is cannabigerolic acid (CBGA).

In some embodiments, a mutation at amino acid position 414 is selected from the group consisting of: A414T, A414I, and A414V. In some embodiments, the mutation at amino acid position 414 results in the variant CBDA synthase producing an increase yield of a CBDA relative to a wild type CBDA synthase or active fragment thereof. In some embodiments, the yield of the variant or active fragment thereof is more than 100% or more than 200% of a yield of CBDA of the wild-type CBDA synthase or active fragment thereof. In some embodiments, the yield is a nMol of CBDA produced per milligram of a substrate. In some embodiments, the substrate is cannabigerolic acid (CBGA).

In some embodiments, a mutation at amino acid position 445 is selected from the group consisting of: I445M, I445L, and I445V. In some embodiments, the mutation I445V results in the variant CBDA synthase producing an increase yield of a CBDA relative to a wild type CBDA synthase or active fragment thereof. In some embodiments, the yield of the variant or active fragment thereof is more than 100% of a yield of CBDA of the wild-type CBDA synthase or active fragment thereof. In some embodiments, the yield is a nMol of CBDA produced per milligram of a substrate. In some embodiments, the substrate is cannabigerolic acid (CBGA).

In some embodiments, the mutation I445L or I445M results in the variant CBDA synthase produces an increased proportion of cannabidiolic acid (CBDA): tetrahydrocannabinolic acid (THCA) relative to a wild type CBDA synthase or active fragment thereof. In some embodiments, a proportion of CBDA:THCA produced by the wild type CBDA synthase or active fragment thereof is about 95:5.

Disclosed herein, in certain embodiments, are variant cannabidiolic acid (CBDA) synthases or active fragments thereof comprising at least two amino acid mutations at amino acid positions selected from the group consisting of: 69, 180, 414, and 445, relative to a wild-type consensus CBDA synthase set forth in SEQ ID NO: 1046. In some embodiments, the at least two amino acid mutations result in the variant CBDA synthase producing an increase yield of a CBDA relative to a wild type CBDA synthase or active fragment thereof. In some embodiments, the yield of the variant or active fragment thereof is more than 100%, more than 200%, more than 300%, more than 400%, more than 500%, more than 600%, more than 700%, or more than 800% of a yield of CBDA of the wild-type CBDA synthase or active fragment thereof. In some embodiments, the yield is a nMol of CBDA produced per milligram of a substrate. In some embodiments, the substrate is cannabigerolic acid (CBGA). In some embodiments, the variant CBDA synthase or active fragment thereof produces an increased proportion of cannabidiolic acid (CBDA): tetrahydrocannabinolic acid (THCA) relative to the wild-type CBDA synthase or active fragment thereof. In some embodiments, a proportion of CBDA:THCA produced by the wild type CBDA synthase or active fragment thereof is about 95:5.

In some embodiments, one of the at least two amino acid mutations is at amino acid position 69. In some embodiments, one of the at least two amino acid mutations at amino acid position 69 is selected from the group consisting of H69A, H69C, H69D, H69E, H69F, H69G, H69I, H69K, H69L, H69M, H69N, H69P, H69Q, H69R, H69S, H69T, H69V, H69W, and H69Y. In some embodiments, one of the at least two amino acid mutations at amino acid position 69 is selected from the group consisting of H69K, H69Q, H69V, and H69G.

In some embodiments, one of the at least two amino acid mutations is at amino acid position 180. In some embodiments, one of the at least two amino acid mutations at amino acid position 180 is selected from the group consisting of C180A, C180D, C180E, C180F, C180G, C180H, C180I, C180K, C180L, C180M, C180N, C180P, C180Q, C180R, C180S, C180T, C180V, C180W, and C180Y.

In some embodiments, one of the at least two amino acid mutations is at amino acid position 414. In some embodiments, one of the at least two amino acid mutations at amino acid position 414 is selected from the group consisting of A414C, A414D, A414E, A414F, A414G, A414H, A414I, A414K, A414L, A414M, A414N, A414P, A414Q, A414R, A414S, A414T, A414V, A414W, and A414Y. In some embodiments, one of the at least two amino acid mutations at amino acid position 414 is selected from the group consisting of: A414V and A414I.

In some embodiments, one of the at least two amino acid mutations is at amino acid position 445. In some embodiments, one of the at least two amino acid mutations at amino acid position 445 is selected from the group consisting of I445A, I445C, I445D, I445E, I445F, I445G, I445H, I445K, I445L, I445M, I445N, I445P, I445Q, I445R, I445S, I445T, I445V, I445W, and I445Y. In some embodiments, one of the at least two amino acid mutations at amino acid position 445 is I445M. In some embodiments, the at least two amino acid mutations are selected from the group consisting of: A414V/H69K, A414V/H69Q, A414V/H69V, A414V/H69G, A414V/I44M, A414I/H69K, I445M/H69K, and I445M/H69Q.

In some embodiments, the variant CBDA synthase comprises at least three amino acid mutations at amino acid positions selected from the group consisting of: 69, 180, 414, and 445, relative to a wild-type consensus CBDA synthase set forth in SEQ ID NO: 1046. In some embodiments, one of the at least three amino acid mutations is at amino acid position 69. In some embodiments, one of the at least three amino acid mutations at amino acid position 69 is selected from the group consisting of H69A, H69C, H69D, H69E, H69F, H69G, H69I, H69K, H69L, H69M, H69N, H69P, H69Q, H69R, H69S, H69T, H69V, H69W, and H69Y. In some embodiments, one of the at least three amino acid mutations at amino acid position 69 is selected from the group consisting of H69K, H69Q, H69V, and H69G. In some embodiments, one of the at least three amino acid mutations is at amino acid position 180. In some embodiments, one of the at least three amino acid mutations at amino acid position 180 is selected from the group consisting of C180A, C180D, C180E, C180F, C180G, C180H, C180I, C180K, C180L, C180M, C180N, C180P, C180Q, C180R, C180S, C180T, C180V, C180W, and C180Y. In some embodiments, one of the at least three amino acid mutations is at amino acid position 414. In some embodiments, one of the at least three amino acid mutations at amino acid position 414 is selected from the group consisting of A414C, A414D, A414E, A414F, A414G, A414H, A414I, A414K, A414L, A414M, A414N, A414P, A414Q, A414R, A414S, A414T, A414V, A414W, and A414Y. In some embodiments, one of the at least three amino acid mutations at amino acid position 414 is selected from the group consisting of: A414V and A414I. In some embodiments, one of the at least three amino acid mutations is at amino acid position 445. In some embodiments, one of the at least three amino acid mutations at amino acid position 445 is selected from the group consisting of I445A, I445C, I445D, I445E, I445F, I445G, I445H, I445K, I445L, I445M, I445N, I445P, I445Q, I445R, I445S, I445T, I445V, I445W, and I445Y. In some embodiments, one of the at least three amino acid mutations at amino acid position 445 is I445M. In some embodiments, the at least three amino acid mutations are H69Q, A414V, and I445M.

Disclosed herein, in certain embodiments, are nucleic acid constructs comprising a nucleic acid encoding the variant cannabinoid synthase or active fragment thereof described herein operably linked to a promoter. Further disclosed herein, in certain embodiments, are vectors comprising the nucleic acid constructs described herein. Further disclosed herein, in certain embodiments, are microorganisms comprising the nucleic acid constructs described herein. In some embodiments, the microorganism is a yeast or a bacteria. In some embodiments, the yeast is a *Saccharomyces cerevisiae*. In some embodiments, the bacteria is an *Escherichia coli*.

Disclosed herein, in certain embodiments, are plants comprising the nucleic acid constructs described herein. The plant can be a vascular plant or a non-vascular plant. In some embodiments, the vascular plant is a plant in the genus *Cannabis*. In some embodiments, the plant is genus *Cannabis* is selected from the group consisting of: *Cannabis satvia*, *Cannabis indica*, and *Cannabis ruderalis*. In some embodiments, the non-vascular plant is a microalgae.

Disclosed herein, in certain embodiments, are methods of producing a cannabinoid, comprising: (i) contacting a cell with a nucleic acid encoding the variant cannabinoid synthase described herein, (ii) expressing the variant cannabinoid synthase, and (iii) isolating a cannabinoid produced by the cell. In some embodiments, the cell is a plant cell or a microorganism cell. In some embodiments, the method further comprises expanding the cell to produce a plurality of expanded cells. In some embodiments, the expanding occurs in a bioreactor. In some embodiments, the method further comprises isolating and purifying the cannabinoid from the plurality of expanded cells. Further disclosed herein, in certain embodiments, are methods of producing a cannabinoid, comprising: contacting the variant cannabinoid synthase described herein to a substrate of the variant cannabinoid synthase. In some embodiments, the contacting occurs ex vivo. In some embodiments, the substrate is a naturally occurring substrate. In some embodiments, the naturally occurring substrate is selected from the group consisting of cannabigerol (CBG), cannabigerolic acid (CBGA), cannbigerovarinic acid (GBGVA), and any homolog thereof. In some embodiments, the substrate is a non-naturally occurring substrate. In some embodiments, the non-naturally occurring substrate can comprise: a non-naturally occurring tail variant, a prenyl donor, or a combination thereof.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the compositions described herein are set forth with particularity in the appended claims. A better understanding of the features and advantages of the present disclosure will be obtained by reference to the following detailed description that sets forth illustrative embodiments, in which the principles of the compositions are utilized, and the accompanying drawings of which:

FIG. 2 shows multiple alignments of amino acid sequence for CBDAS (SEQ ID NO: 1043; CBDA_E55107.1), THCAS (SEQ ID NO: 1044; THCAS_E33090.1), and CBCAS (SEQ ID NO: 1045; CBCAS_JP2016). The top sequence (SEQ ID NO: 1082) represents the amino acid sequence in standard IUPAC notation for SEQ ID NO: 1043. In the remainder of the alignments a dot (.) represents identity to the top CBDAS sequence, a letter represents a substitution relative to the top CBDAS sequence. The sequence CBDAS_AA_consensus (SEQ ID NO: 1046) represents the sequence used in the current cloning study. The signaling sequence that was used in this study is positioned on the 5' end of the sequence and is marked in lower case standard IUPAC amino acid codes. The signaling sequence region is demarcated with white diamonds (◊). Greyscale highlighted amino acid positions are targets for site saturated mutagenesis. The sequence for CBCAS (SEQ ID NO: 1045; CBCAS_JP2016) is derived from patent application US20170211049A1 (Page and Stout 2016). Deep pocket sites are marked with solid square (■). Outer pocket sites are marked with white square (□).

FIG. 3 shows multiple sequence alignment for parsimony informative sites that differentiate the CBCAS clade vs the THCAS clade (Table 15). Grey highlight indicates sites where CBCAS harbors a derived (i.e. non-ancestral CBDAS state) substitution. Black squares (■) indicate sites that are differentially changed relative to CBDAS both in THCAS and CBCAS. These sites may have experience relaxed selection, and/or are candidates for evolutionarily "malleable" sites. White diamonds (◊) indicate sites that are evolutionarily conserved in the other synthases (i.e. CBDAS and THCAS), while these sites present amino acid substitutions in CBCAS. The evolutionary conservation of sites suggests a functional role, so changes in CBCAS may yield unique functional effect. Substitutions were also categorized as those that change the type of amino acid side chain (●) compared to substitutions that retain the same type of amino acid side chain (○). FIG. 3 discloses SEQ ID NOS 1065-1080, respectively, in order of appearance.

FIG. 6 shows consensus reference sequence for cloning CBDAS with *S. cerevisiae* codon optimization (SEQ ID NO: 1049). Nucleotide sequence is marked in bold capital letters. 1-letter amino acid (SEQ ID NO: 1046) translation is listed below (and in the center) of each 3-nucleotide codon. Greyscale highlighted codons are targets for site saturated mutagenesis with the amino acid position relative to CBDAS_E55107.1 demarcated below.

FIG. 7 shows consensus reference sequence for cloning THCAS with *S. cerevisiae* codon optimization (SEQ ID NO: 1050). Nucleotide sequence is marked in bold capital letters. 1-letter amino acid translation is listed below (and in the center) of each 3-nucleotide codon. Greyscale highlighted codons are targets for site saturated mutagenesis with the amino acid position relative to THCAS_E33090.1 demarcated below.

DETAILED DESCRIPTION

Figure 1A:
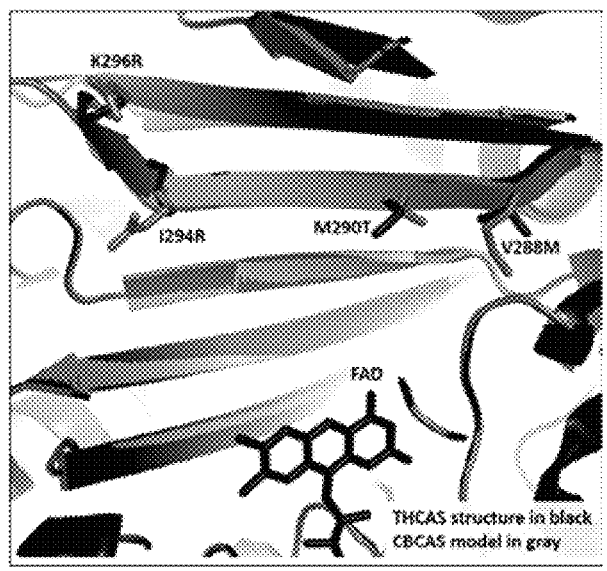
FIG. 1A shows superposition of the THCAS structure 3VTE (black) and homology model of CBCAS (gray). The protein backbone is shown in cartoon form. The four amino acid residue changes identified (V288M, M290T, I294R, and K296R) are shown as stick figures in black for the THCAS structure, and gray for the CBCAS homology model. The flavin cofactor from structure 3VTE is shown in black.

The primary cannabinoid components in *C. sativa*, affect receptors throughout the human body mainly by activating two specific cannabinoid receptors (CB1 and CB2). These receptors also bind 'endogenous' cannabinoids (i.e. endo-cannabinoids), which are naturally produced by the human body. Recent studies of the cannabinoid signaling system shows its involvement in a variety of pathological conditions. Olivetol and olivetolic acid are important intermediates in the biosynthesis of the therapeutic plant derived polyketide-terpene natural cannabinoid products found in *Cannabis sativa*. These intermediates are prenylated by the *C. sativa* endogenous prenyltransferase (CsPT1) to create CBG and CBGA respectively and it is this reaction that is believed to be one of the limiting steps in creating an engineered cannabinoid pathway in a micro-organism. CBGA is the central precursor molecule used to synthesize most of the known phytocannabinoids in the plant. Most phytocannabinoids require a single synthase enzyme to convert CBGA to a given phytocannabinoid. For example, Tetrahydrocannabinolic acid synthase, Cannabidiolic acid synthase and Cannabichromenic acid synthase convert CBGA to THCA, CBDA and CBCA, respectively. Many of the plant cannabinoids are non-psychoactive (e.g. CBD, CBN) and appear to have medicinal properties but are produced by the plant at very low levels. These desirable cannabinoids are not easily separated into pure forms when extracted from the cannabinoid plant and obtaining these non-abundant cannabinoids in industrial pure forms would be cost prohibitive, so reconstruction of the cannabinoid pathway in a micro-organism as described herein provides the solution and the key to the development of these cannabinoids into human therapeutics. Expressing a soluble cannabinoid synthase that is able to produce a natural or novel cannabinoid with high productivity, purity, or the combination thereof could be critical to successfully expressing the cannabinoid plant pathway in a micro-organism for therapeutic applications. Natural cannabinoid synthases do not exhibit high fidelity in product formation by producing a heterogeneous mixture of multiple cannabinoid molecules. For example, CBDAS produces both CBDA and THCA at a ratio of 95% to 5% respectively. Also, THCA is reported to produce both THCA and CBCA under specific reaction conditions. Such a heterogeneous mixture of products is suboptimal for most controlled therapeutic applications.

Described herein, in certain embodiments, are novel cannabinoid synthases (also referred to herein as variant cannabinoid synthases) or active fragments thereof comprising a non-naturally occurring amino acid sequence relative to a wild-type cannabinoid synthase or active fragment thereof. In some embodiments, the variant cannabinoid synthase can act on a substrate to produce an altered amount of a cannabinoid relative to an amount of the cannabinoid produced by the wild-type cannabinoid synthase or active fragment thereof. Altering the amount of the cannabinoid can comprise a change the ratio of the products produced relative to the native CBDAS, THCAS and/or CBCAS cannabinoid synthase protein. Specifically, in some embodiments, a useful and improved variant cannabinoid synthase produces only a single cannabinoid product with very high-fidelity, thus yielding a homogeneous and pure product amenable for therapeutic applications. Accordingly, provided herein in some embodiments, are variant cannabinoid synthase proteins that produce 100% CBDA, or 100% THCA, or 100% CBCA or 100% of another cannabinoid. Further provided herein, in some embodiments, are variant cannabinoid synthase proteins that produce a higher amount, or yield, of cannabinoids relative to a wild type cannabinoid synthase protein. Further provided herein, in some embodiments, are variant cannabinoid synthase proteins that produce a lower amount, or yield, of cannabinoids relative to a wild type cannabinoid synthase protein.

In some instances, to create these cannabinoid synthases, a library of protein variants of cannabinoid synthases can be constructed, by synthesizing cannabinoid synthase genes and inserting rationally targeted amino acid substitutions. These mutated cannabinoid synthase genes can be expressed, purified and tested for the enzyme activity that could alter the repertoire of the respective cannabinoid synthase in a desired manner to create an enzymatic production system for natural or novel cannabinoid molecules in micro-organisms. This cannabinoid synthases, methods, systems and microorganisms provided herein, in certain embodiments, open up new therapeutic avenues based on the ability to modulate the endocannabinoid system.

As described herein, novel cannabinoid synthase amino acid sequences that alter the enzyme repertoire relative to naturally occurring cannabinoid synthase (i.e. "AA_Consensus" or "native consensus sequence"). In some embodiments, variant cannabinoid synthases are provided that produce 100% CBDA; that produce 100% CBCA; and/or that produce other cannabinoids different from the WT parental cannabinoid. Also provided herein, in some embodiments, are novel variant cannabinoid synthases that have improved enzyme kinetics. These un-natural variants were initially identified in the context of single substitution variants, and combinations of multiple substitutions are also provided herein and these cannabinoid synthases govern the novel oxidocyclization phenotype. These novel enzymes may be employed to exogenously express the cannabinoid biosynthesis pathway for large scale microbial production of cannabinoids.

Expressing a soluble cannabinoid synthase with specific control of basic functional repertoires (i.e. substrate binding, efficiency of conversion of the substrate and the oxidocyclization products profile) is contemplated herein as useful in expressing the phytocannabinoid biosynthesis pathway exogenously in a microorganism for industrial purposes. This can permit the expression of desirable cannabinoids, including non-abundant phytocannabinoids, at an industrial scale and in pure form to enable development of these phytocannabinoids for applications such as human therapeutics, nutraceuticals and other applications.

Other features and advantages of the cannabinoid synthases described herein will become more readily apparent to those of ordinary skill in the art after reviewing the following detailed description and accompanying drawings.

Described herein, in certain embodiments, are cannabinoid synthases, nucleic acids encoding some forms of novel protein variants of cannabinoid synthases, and various uses thereof. In one embodiment, methods are provided for using site-directed mutagenesis to create libraries and/or individual un-natural protein variants to change the protein activity of substrate binding, efficiency of conversion of these substrates, the oxidocyclization products profile specificity of these cognate un-natural cannabinoid synthases. In another embodiment, methods of screening these protein variants are provide to identify those which have altered activities and/or protein stability. In another embodiment, methods of screening compounds to identify compounds which bind to these un-natural cannabinoid synthases and/or modulate the activity thereof are provided. In yet another embodiment, methods of screening compounds to identify potential substrates for these un-natural cannabinoid synthases are provided. In still another embodiment, methods are provided for oxidocyclization of certain substrates, as well as controlling and/or modifying the degree of oxidocyclization promoted by these un-natural cannabinoid synthases. In another embodiment, methods are provided for combining the site mutations of individual protein variants that change general protein activity and or stability, into new combined protein variants with enhanced general protein activity and or stability over the individual parental protein variant. In a still further embodiment, methods are provided for stacking mutations, of individual cannabinoid synthase proteins, that change the same specific protein activity (i.e. substrate binding, efficiency of conversion of these substrate, product profile of oxidocyclization products) in each individual protein variants into a new combined protein variant that combines these different mutations into one protein that further enhances the specific protein activity over the individual mutation and the individual parental protein variants. In a still further embodiment, methods are provided for combining one or more novel enhanced protein activities (i.e. substrate binding, efficiency of conversion of these substrate, profile of oxidocyclization products) together into an individual protein variant that has many enhanced protein activities all in one protein variant, tailored to create an un-natural cannabinoid synthase that would produce a specific group and/or individual cannabinoids.

The biochemical reaction catalyzed by THCAS is the two-electron oxidative cyclization of CBGA, catalyzed by the FAD cofactor, producing THCA and FADH2. CBDAS catalyzes the nearly identical two-electron oxidative cyclization of CBGA by FAD, producing CBDA and FADH2. Likewise, cannabichromenic acid synthase (CBCAS) catalyzes the two-electron oxidative cyclization of CBGA by FAD, producing CBCA and FADH2. In all cases, the FADH2 is thought to react with molecular oxygen to regenerate the FAD and produce hydrogen peroxide from oxygen. Because of the identical substrates and related products, it is contemplated herein that cannabinoid produced from the transition state is determined by the shape and electrostatic environment of the synthase's active site and surrounding residues.

Since THCAS and CBDAS share many similarities in their biochemical properties, including protein mass (74 Kd), to the pI, Vmax and Km for CBGA and the amino-acid sequences being 84% identical, it is believed that the THCAS is thought to have evolved from CBDAS by gene duplication and divergence. Homology modeling between THCAS and CBDAS (or CBCAS) has been utilized to identify unique residues in the active site and other functional sites of each cannabinoid synthase for the subsequent design of mutational libraries within and around these residues coding for non-naturally occurring variant cannabinoid synthases (e.g., variant CBDAS, THCAS or CBCAS proteins). In one embodiment, the novel cannabinoid synthases provided herein are contemplated herein to bind and catalyze the oxidocyclization of new substrates; and to control product profile and the relative efficiency of each synthase.

Described herein, in certain embodiments, are five newly constructed different libraries, that allow the control of the basic functional repertoire of the cannabinoid synthases (CBDAS, THCAS and CBCAS), such as, e.g., controlling substrate binding, efficiency of conversion of the substrates and the oxidocyclization products profile. By creating libraries of mutations in these cannabinoid synthase proteins and screening the libraries according to the methods provided herein, improved un-natural novel protein variants of cannabinoid synthases have been identified that broaden the ranges of these basic functional aspects.

Figure 5A:
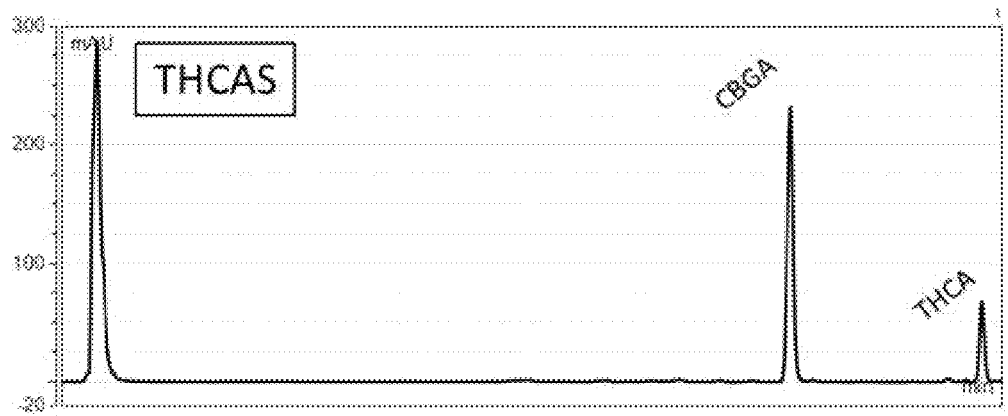
FIG. 5A shows liquid chromatography results for a THCAS reaction.
Figure 5B:
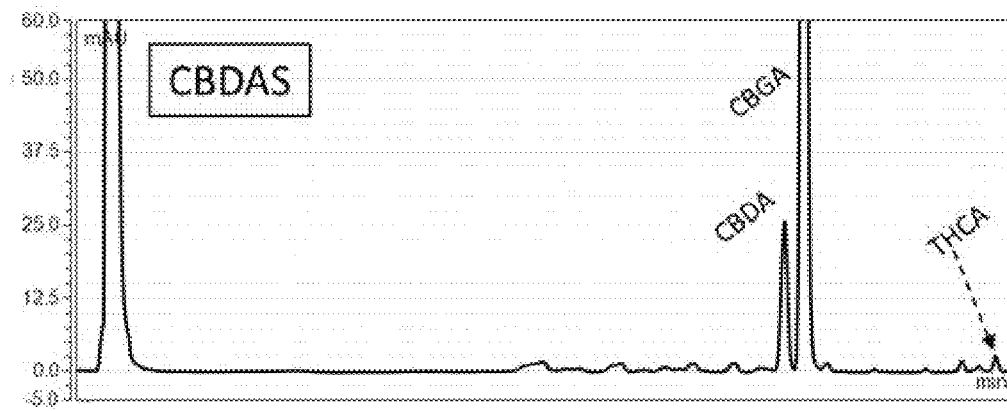
FIG. 5B shows liquid chromatography results for a CBDAS reaction.
Figure 5C:
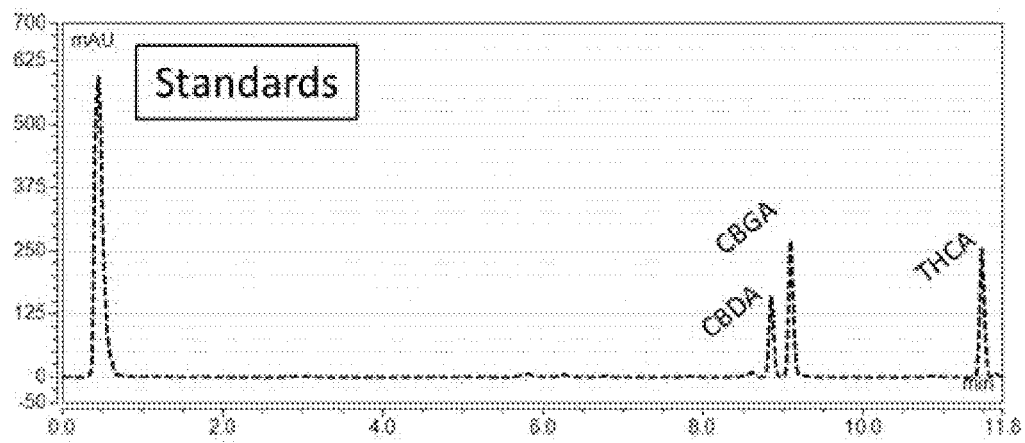
FIG. 5C shows liquid chromatography results of a standard.

Although the native CBDAS can convert CBGA at an efficiency of 95% to CBDA, it also has an off-target conversion and produces 5% of THCA from CBGA (FIG. 5B). This 5% THCA contamination produced by the native CBDAS prevents the production of CBDA and it derivatives in a pure form, which in turn has a negative impact on the commercialization of these cannabinoids into a therapeutic drug from a perspective of quality control and legal regulations on THC.

To optimize CBDAS activity for utilization in an exogenous phytocannabinoid biosynthesis pathway, in particular embodiments, two libraries of novel variants of CBDAS were created that are contemplated herein to improve productivity of CBDA. Accordingly, these two libraries of select novel CBDAS variants have been designed to elucidate the amino acid diversity in the active site and outer pocket of the CBDAS and elucidate novel combinations of natural mutations of native CBDAS to increase CBDA production from CBGA by either increasing the efficiency of oxidocyclization conversion of CBGA or increasing the product profile to >95% CBDA, with little to no THCA off targeting. In either or both cases, these novel CBDAS variants are contemplated herein to surpass the efficiency of the native CBDAS and produce more CBDA per CBGA input. Also, in one embodiment, an improved CBDAS enzyme efficiently accepts CBG as a substrate, (as opposed to the acid form, CBGA) to produce non-acid form cannabinoids. In this embodiment, these non-acid form cannabinoids bind more readily to human CB1 and CB2 receptors, and are preferred for therapeutic purposes. These new CBDAS variants are unnatural variant cannabinoid synthases.

In another embodiment, provide herein is a library of select novel THCAS variants that convert the native THCAS to produce THCA from CBGA with an increase in the efficiency of oxidocyclization conversion of CBGA, or changing the product profile of the variant THCAS to >95% CBDA or another cannabinoid. These THCAS variants are contemplated herein to surpass the efficiency of the native CBDAS and producing more CBDA per CBGA input. In another embodiment, an improved THCAS enzyme efficiently accepts CBG as a substrate to create THC and/or CBD or another cannabinoid. These new THCAS variants are unnatural variant cannabinoid synthases.

In another embodiment, provided herein is a library to elucidate the amino acid diversity in the active site and outer pocket of the THCAS and its effect on product profile. In this embodiment, 8 amino acid positions have been identified in THCAS and a library is created to explore the effect of amino acid diversity by replacing at each of these 8 positions with the remaining 19 natural amino acid. These THCAS variants are contemplated herein to increase THCA production, or produce CBCA from CBGA by increasing the efficiency of oxidocyclization conversion of CBGA. These THCAS variants are contemplated herein as surpassing the efficiency of the native THCAS and producing more THCA or CBCA per CBGA input. In other embodiments, these improved THCAS enzyme efficiently accept CBG as a substrate to create THC and/or CBC. These new THCAS variants are unnatural variant cannabinoid synthases.

In yet another embodiment, provided herein is library constructed to improve performance of CBCAS, by elucidating the amino acid diversity in n=14 selected amino acid sites in the CBCAS, chosen by evolutionary analysis (FIG. 3) and rational enzyme engineering. Using these selected n=14 amino acid positions in CBCAS, a library is generated by replacing the native amino acid at each of these n=14 positions with the remaining 19 natural amino acid. These CBCAS variants are contemplated herein to increase CBCA production by increasing the efficiency of oxidocyclization conversion of CBGA. The specific sites are Q31, E40, P46, T74, V90, M163, A255, M288, T290, R294, L318, L391, T448, and E495. All alternative amino acids substitutions are tested at these n=14 sites (Table 5). These new CBCAS variants are unnatural variant cannabinoid synthases.

Provided herein are novel variant cannabinoid synthases (e.g., CBDAS, THCAS and CBCAS) having an altered amino acid structure and altered function compared to the respective wild-type or native consensus cannabinoid synthase (e.g., those set forth in FIG. 2, Table 14, and the like). Specific functions to be altered may include the following: substrate binding, efficiency of conversion of the substrate, product profile of oxidocyclization products, and the like. The cannabinoid synthase variants allow for the production of specific small molecules (e.g., cannabinoids) that can interact with diverse biological targets; and are useful to create pharmaceutical drugs as well as chemical probes to unveil basic molecular pathways germane to health and disease. Natural products have always been an important source for new pharmaceutical drugs and controlling cannabinoid synthases provides access to a rich chemical diversity of novel (yet biosynthetically natural) molecules, thereby creating an enzymatic production system for novel small molecules.

It is well-known that cannabinoid synthases such as the homologous enzymes, THCAS, CBDAS or CBCAS, can be defined and classified by a functional repertoire that includes two primary components: (i) substrate utilization; and (ii) profile of products formed. Provided herein, in certain embodiments, are novel variants of these cannabinoid synthases that have a repertoire which is significantly different than the native cannabinoid synthase. In particular embodiments, novel unnatural cannabinoid synthase enzymes are provided (e.g., THCAS, CBDAS and CBCAS) that have improved characteristics towards optimal heterologous expression and activity of cannabinoid synthases in yeast spp., microalgae spp., and bacteria spp. The cannabinoid synthases can also be used in transgenic plants including, but not limited to C. sativa. These improved characteristics in the cannabinoid synthases provided herein include, for example, increased enzymatic efficiency, improved substrate utilization, novel substrate utilization, increased homogeneity of oxidocyclization product, or alternatively, preferred diversification of oxidocyclization products, and novel oxidocyclization product formation for both natural and unnatural cannabinoids. In one embodiment, one primary targeted improvement provides a novel synthase that accepts CBG (as opposed to the acid form, CBGA) to produce non-acid form cannabinoids. These non-acid form cannabinoids bind more readily to human CB1 and CB2 receptors, so non-acid form cannabinoids are contemplate herein, in one embodiment, as being preferred for therapeutic purposes. By altering and controlling the characteristic product formation, the cannabinoid synthases provided herein can be used to produce a variety of cannabinoids, either commonly found in *C. sativa* plants, or in low abundance in *C. sativa* plants, or never found in *C. sativa* plants. The repertoire components that govern these characteristics of an variant cannabinoid synthase can be defined as follows:

(i) Substrate utilization: Native cannabinoid synthases bind CBGA and its alkyl homologs as substrates. All the CBGA alkyl-homologs can be used as substrate and transformed by the different cannabinoid synthases in vitro, although the efficiency of oxidocyclization conversion is known to be different for each of the different cannabinoid synthases. The most common cannabinoids have a pentyl side-chain, but propyl homologs can also occur in vivo. Methyl-cannabinoids are also known, although these are only rarely present and typically in very small amounts in plants. Provided herein, in certain embodiments, are panels of novel variant cannabinoid synthases were created by mutagenesis techniques and screened for oxidocyclization by preparing appropriate enzymatic reactions with CBGA or a specific alkyl-homolog or a new unknown substrate, or CBG; and then analyzing these reactions by liquid chromatography techniques (e.g. HPLC). An oxidocyclization event is successful if a known or new derivative chemical species is produced or the efficiency of conversion is changed with a known substrate enzymatically in a reaction between the novel cannabinoid synthases and substrate. In another embodiment, novel cannabinoid synthases are provided that accept new substrates which native cannabinoid synthases do not accept, and/or change the efficiency of oxidocyclization conversion with a known substrate relative to natural cannabinoid synthases. The new substrate can be a naturally occurring substrate. For example, the naturally occurring new substrate can be naturally occurring CBGA or any alkyl-homolog or derivative thereof. The substrate can be a non-naturally occurring substrate. In some embodiments, the non-naturally occurring substrate is a non-naturally occurring CBGA.

Figure 18:
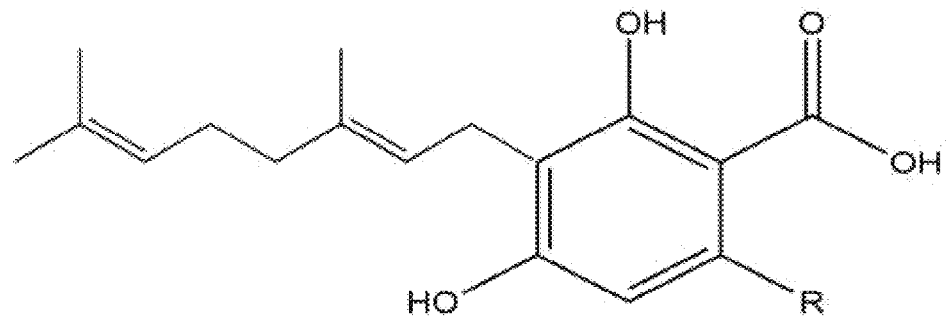
FIG. 18 illustrates a CBGA structure with an R group indicating the location of a tail variant.
Figure 19:
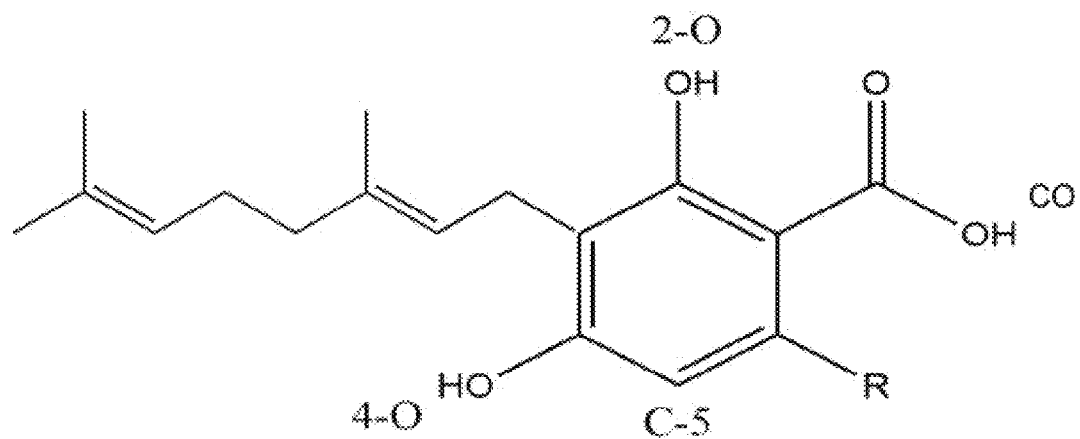
FIG. 19 illustrates a CBGA structure with an R group indicating the location of a tail variant and the labeled positions 2-O, CO, C-5, and 4-O indicating positions for attachment of a prenyl donor.

The non-naturally occurring CBGA can be a non-naturally occurring substrate comprising a non-naturally occurring tail variant. The non-naturally occurring tail variant can be a carbon chain or an aromatic ring. The tail can be branched carbon chain. The carbon chain can comprise 1 carbon, 2 carbons, a 3 carbons, a 4 carbons, a 5 carbons, a 6 carbons, a 7 carbons, an 8 carbons, a 9 carbons, a 10 carbons, or a more than 10 carbons. The non-naturally occurring tail variant can be the absence of a carbon chain. In one example, the non-naturally occurring CBGA can be non-naturally occurring CBGA illustrated by the formula in FIG. 18, wherein the R group indicates a non-naturally occurring tail variant. The non-naturally occurring CBGA can comprise at least one prenyl donor. The prenyl donor can be dimethylallyl diphosphate (DMAPP), geranyl diphosphate (GPP), farnesyl diphosphate (FPP), geranylgeranyl pyrophosphate (GGPP), or a combination thereof. The non-naturally occurring CBGA can comprise a non-naturally occurring tail variant and at least one prenyl donor. In one example, the non-naturally occurring CBGA can be a non-naturally occurring CBGA illustrated by the formula in FIG. 19.

(ii) Profile of oxidocyclization products formed (i.e. "product profile"): Native cannabinoid synthases, THCAS and CBCAS, naturally yield a specific product profile for each specific substrate it binds. THCAS makes 100% THCA under standard conditions (pH 5.5) (FIG. 5a), yet it has been reported to make a small percent of CBCA at higher pH 8-9 (see, e.g., U.S. Pat. No. 9,861,609). CBCAS appears to make CBCA but, it is was previously unclear whether or not it makes some THCA in the same reaction under standard conditions, since distinguishing between THCA and CBCA by HPLC alone is not effective. In the case of CBDAS, a heterogenous mixture of CBDA and THCA is produced in a ratio of 95% CBDA to 5% THCA (FIG. 5b) when utilizing CBGA as a substrate, under standard conditions. Under specified assay conditions (including pH, temperature, cofactor concentration, substrate, etc.), the specific oxidocyclization product and the proportion of the different oxidocyclization products is predictable and characteristic of the given conditions. Such a characteristic oxidocyclization product or ratio of oxidocyclization products is referred to herein as the cannabinoid synthase's profile of products (or "product profile"). The herein reported "standard assay reaction" for THCAS and CBDAS was used to assess oxidocyclization activity and product profile. (The standard assay reaction was performed in a volume of 20-100 microliters and contained 20 millimolar sodium citrate pH 5.5, 0.2 millimolar CBGA and active cannabinoid synthase protein or cannabinoid synthase variant protein. These reactions were incubated for 16 hours at 37° C.). The standard THCAS reaction yields a product profile that is characterized by 100% THCA (FIG. 5A) The standard CBDAS reaction yields a product profile that is characterized 95% (±1%) CBDA and 5% (±1%) THCA (FIG. 5B). In some embodiments, novel cannabinoid synthases (e.g., CBDAS, THCAS and CBCAS) derived from the native cannabinoid synthases are provided herein that exhibit a product profile which is significantly different from the native cannabinoid synthases under standard assay reaction conditions. A significantly altered product profile can be defined by observing any new product (as in the case of THCAS which is 100% THCA) and/or a change in a newly produced product in a proportion that is equal or greater than about 1% up to about 95%, about 2% up to about 85%, about 3% up to about 75%, about 4% up to about 65%, about 5% up to about 55%, about 6% up to about 45%, about 7% up to about 35%, about 8% up to about 25%, about 9% up to about 15% of total oxidocyclization product compared to the standard oxidocyclization product profile for the respective CBDAS, THCAS or CBCAS enzyme. In other embodiments, a significantly altered product profile is defined by observing any new product and/or a change in a newly produced product in a proportion that is equal or greater than about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30% up to about 95% of total oxidocyclization product compared to the standard oxidocyclization product profile for the respective CBDAS, THCAS or CBCAS enzyme. In this particular embodiment, an example would be the production of any CBCA or any CBDA in a THCAS standard reaction. In another embodiment, another example is a variant version of CBDAS (a variant CBDA synthase) that yields a product profile with a 4% (more or less) of CBDA and/or a 4% (less or more) of THCA. A novel product profile may also include additional novel oxidocyclization products in the profile mixture and is not restricted only to changes in product proportions.

A significantly altered product profile can be defined by an increase in the yield or the decrease in the yield of at least one cannabinoid. The cannabinoid can be a cannabichromene, a cannabicyclol, a cannbidiol, a cannabielsoin, a cannabigerol, a cannabinol, a cannabinodiol, a cannbitriol, a tetrahydrocannabinol, a cannbichromanon (CBCF), a cannabifuran (CBF), cannabiglendol, a cannabiripsol (CBR), a cannbicitran (CBT), a dehydrocannabifuran (DCBF), or any combination thereof. The cannabichromene can be a cannabichromene (CBC), cannabichromevarin (CBCV), cannabichromenic acid (CBCA), or a combination thereof. The cannabidiol can be a cannabidiolic acid (CBDA), cannabidiol (CBD), cannabidivarin (CBDV), or a combination thereof. The tetrahydrocannabinol can be a tetrahydrocannabinolic acid (THCA), tetrahydrocannabinol (THC), tetrahydrocannabinvarin (THCV), or a combination thereof. The increase in amount or yield can be the production of a cannabinoid not produced by the wild type cannabinoid synthase.

The significantly altered product profile can be an altered amount of a cannabinoid produced by the variant cannabinoid synthase. The amount, also referred to herein as the yield, can be a nMol of cannabinoid produced per milligram of substrate. The substrate can be a naturally occurring substrate. The naturally occurring substrate can be cannabigerol (CBG), cannabigerolic acid (CBGA), cannbigerovarinic acid (GBGVA), or any alkyl homolog or derivative thereof. The substrate can be cannabigerol (CBG), cannabigerolic acid (CBGA), cannbigerovarinic acid (GBGVA), or any alkyl homolog thereof. The substrate can be a non-naturally occurring substrate. In some embodiments, the non-naturally occurring substrate is a non-naturally occurring CBGA. The non-naturally occurring CBGA can be a non-naturally occurring CBGA comprising a non-naturally occurring tail variant. The non-naturally occurring tail variant can be a carbon chain or an aromatic ring. The tail can be branched carbon chain. The carbon chain can comprise 1 carbon, 2 carbons, a 3 carbons, a 4 carbons, a 5 carbons, a 6 carbons, a 7 carbons, an 8 carbons, a 9 carbons, a 10 carbon s, or a more than 10 carbons. The non-naturally occurring tail variant can be the absence of a carbon chain. In one example, the non-naturally occurring CBGA can be non-naturally occurring CBGA illustrated by the formula in FIG. 18, wherein the R group indicates a non-naturally occurring tail variant. The non-naturally occurring CBGA can further comprise at least one prenyl donor. The prenyl donor can be dimethylallyl diphosphate (DMAPP), geranyl diphosphate (GPP), farnesyl diphosphate (FPP), geranylgeranyl pyrophosphate (GGPP), or a combination thereof. In one example, the non-naturally occurring CBGA can be a non-naturally occurring CBGA illustrated by the formula in FIG. 19.

In some embodiments, the yield of the cannabinoid produced by the variant cannabinoid synthase is more than 100% of the yield produced by a wild-type cannabinoid synthase. In some embodiments, the yield of the cannabinoid produced by the variant cannabinoid synthase is less than 100% of the yield of the cannabinoid produced by the produced by a wild-type cannabinoid synthase. In some embodiments, the yield of the cannabinoid produced by the variant cannabinoid synthase is more than 200% of the yield of the cannabinoid produced by the produced by a wild-type cannabinoid synthase. In some embodiments, the yield of the cannabinoid produced by the variant cannabinoid synthase is less than 200% of the yield produced of the cannabinoid produced by the by a wild-type cannabinoid synthase. In some embodiments, the yield of the cannabinoid produced by the variant cannabinoid synthase is more than 300% of the yield of the cannabinoid produced by the produced by a wild-type cannabinoid synthase. In some embodiments, the yield of the cannabinoid produced by the variant cannabinoid synthase is less than 300% of the yield of the cannabinoid produced by a wild-type cannabinoid synthase. In some embodiments, the yield of the cannabinoid produced by the variant cannabinoid synthase is more than 100%, more than 200%, more than 300% more than 400%, more than 500%, more than 600%, more than 700%, or more than 800% of the yield of the cannabinoid produced by the produced by a wild-type cannabinoid synthase. In some embodiments, the yield of the cannabinoid produced by the variant cannabinoid synthase is less than 100%, less than 200%, less than 300% less than 400%, less than 500%, less than 600%, less than 700%, or less than 800% of the yield of the cannabinoid produced by a wild-type cannabinoid synthase. The altered amount of a cannabinoid produced by the variant cannabinoid synthase can comprise production of any amount of the cannabinoid if the cannabinoid is not produced by the wild-type cannabinoid synthase.

Site-directed mutagenesis of the amino acid residues in the native cannabinoid synthase can be employed to advantageously alter the basic functional repertoire of the cannabinoid synthases, including, for example, substrate binding, efficiency of conversion of these substrates, the oxidocyclization products profile, and the like. By creating libraries of mutations in the cannabinoid synthase proteins, un-natural novel protein variants of cannabinoid synthases can be provided that broaden the ranges of these basic functional aspects of cannabinoid synthase and allow for the control of oxidocyclization; and variant cannabinoid synthases are provided that produce specific cannabinoids or novel cannabinoids never enzymatically produced before.

The enzyme THCA synthase (THCAS) and CBDA synthase (CBDAS) can be separately cloned, heterologously expressed in microorganisms such as yeast, microalgae, and bacteria, and can produce THCA and CBDA from CBGA via oxidative cyclization. CBCAS has received less treatment in peer reviewed literature. At a protein level the sequences for CBDAS and CBCAS are very similar to that of THCAS (>80% identity). Within the active site of these synthases, the protein sequences are even more similar. Given that the same single molecule substrate (CBGA or an alkyl homolog) is used by any of these cannabinoid synthase enzymes to produce their diverse products, homology-based modeling can be utilized to identify residues in the "deep active site" and in the "outer pocket" that could (i) control oxidocyclization product profile of the specific substrate used, (ii) the kinetics and/or efficiency of oxidocyclization conversion seen with that specific substrate and (iii) the binding of a new substrate (or multiple substrates) to create a novel cannabinoid or multiple cannabinoids. Homology-based modeling of CBDAS and CBCAS can be conducted using the Swiss-MODEL server (https://swissmodel.expasy.org/), the source coordinates were derived from the structure of THCAS, the only know cannabinoid synthase crystal structure solved to date, PDB ID 3VTE.

Figure 1B:
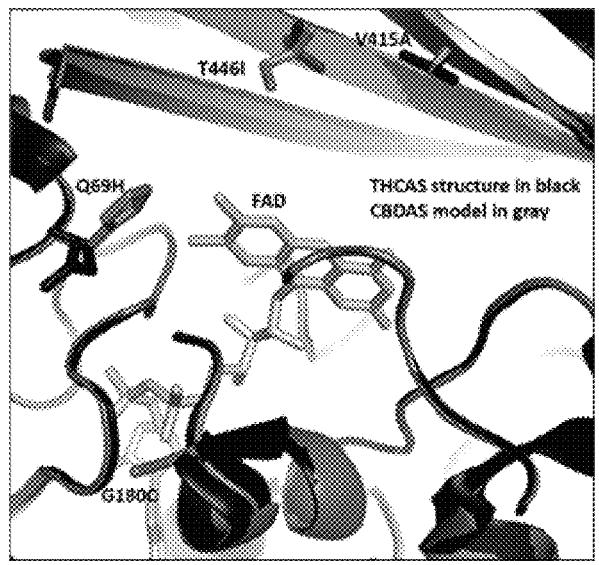
FIG. 1B shows superposition of the THCAS structure 3VTE (black) and homology model of CBDAS (gray). The protein backbone is shown in cartoon form. The active site amino acid residue substitutions (n=4) identified in the active site (i.e. Q69H, G180C, V415A, and T446I) are shown as stick figures in black for the THCAS structure, and gray for the CBDAS homology model. The flavin cofactor from structure 3VTE is shown in gray.

The active site of CBDAS is more divergent from THCAS compared to the divergence between CBCAS and THCAS. Based on this homology-based protein modeling, the active site of CBDAS was shown to exhibit four amino acid differences from THCAS in the "deep active site" near the catalytic FAD cofactor (FIG. 1). [Note: A multiple alignment of the complete amino acid sequences between CBDAS and THCAS displays an amino acid insertion/deletion event at alignment position 253. Accordingly, THCAS (and CBCAS) displays a serine (S) insertion at alignment site 253 (see FIG. 2). It follows that all homologous amino acid positions >=253 through 544 on CBDAS, respectively correlate to the homologous positions >=254 through 545 on THCAS and CBCAS] The identified divergent amino acids in the "deep active site" are as follows (according to standard IUPAC notation, the CBDAS residue is listed first, the CBDAS amino acid position is listed second, while the homologous THCAS residue is listed last): H69Q, C180Q, A414V (homologous to amino acid position 415 in THCAS), and I445T (homologous to amino acid position 446 in THCAS) (FIG. 1). It is contemplated herein that several of these amino acid substitutions can produce significant changes to the active site shape and electrostatic environment and alter product resolution from the transition state.

In another embodiment, four additional changes were also identified in the "outer pocket" of CBDAS relative to THCAS. These are contemplated herein to impact kinetics or product identity by alteration of protein flexibility. In this embodiment, the positions of these substitutions on CBDAS are M256I, R295K, Q376K, and N377K. (CBDA residue is listed first, while THCAS residue listed second). One of these (R295K) is the same in CBDAS and CBCAS described above.

Because of the high sequence similarity between THCAS, CBCAS, and CBDAS, it is contemplated herein, in some embodiments, that generating amino acid diversity via site directed mutagenesis, control can be achieved of: (i) product profile of the specific substrate/s used, (ii) the kinetics and efficiency of oxidocyclization conversion seen with specific substrate/s (iii) the binding of a new substrate to create a novel cannabinoid. Rational model-based design has identified residues in THCAS relative to CBCAS and relative to CBDAS. In particular embodiments, altering all or some subset of these residues can produce novel variant enzymes divergent from THCAS that: 1) produces CBCA, CBDA, or another non-THCA cannabinoid from CBGA and its alkyl-homologs; 2) produces a novel variant of CBDAS that produces THCA, CBCA or another non-CBDA cannabinoid; and/or 3) produces a novel variant of CBCAS that produces CBDA, THCA or another non-CBCA cannabinoid. See FIGS. 1A & 1B.

Figure 3:
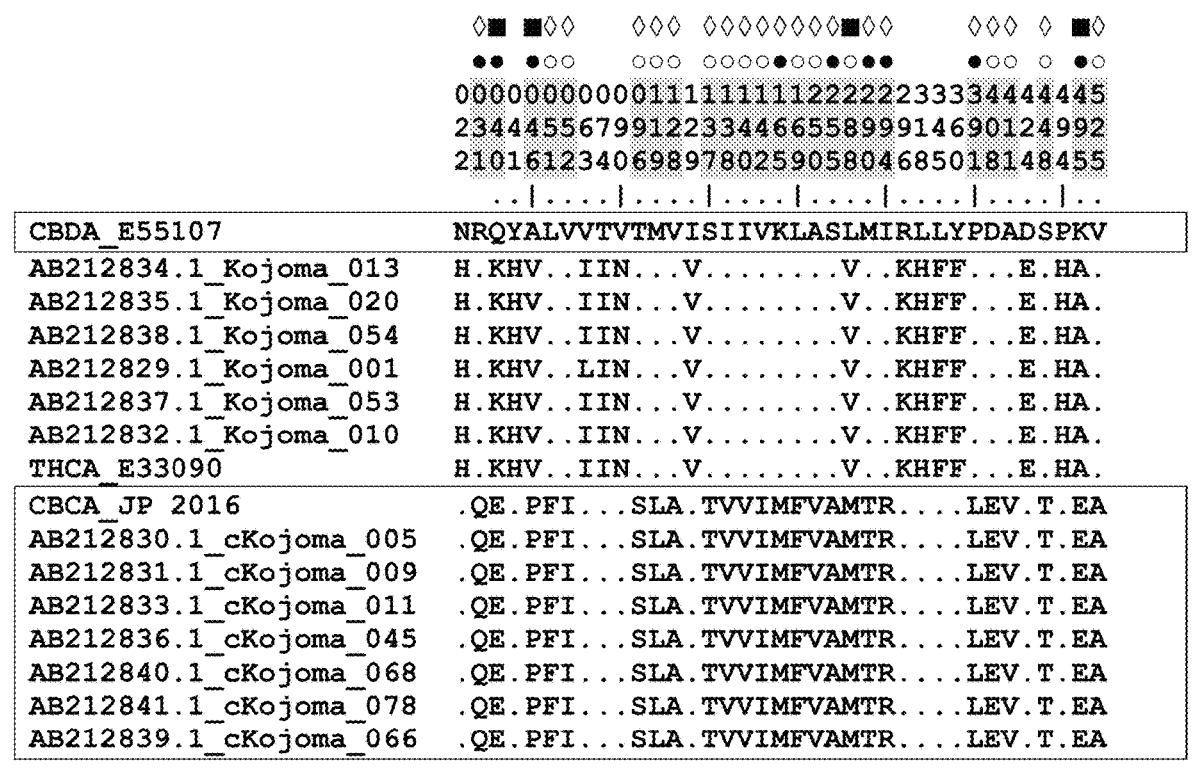
Figure 4:
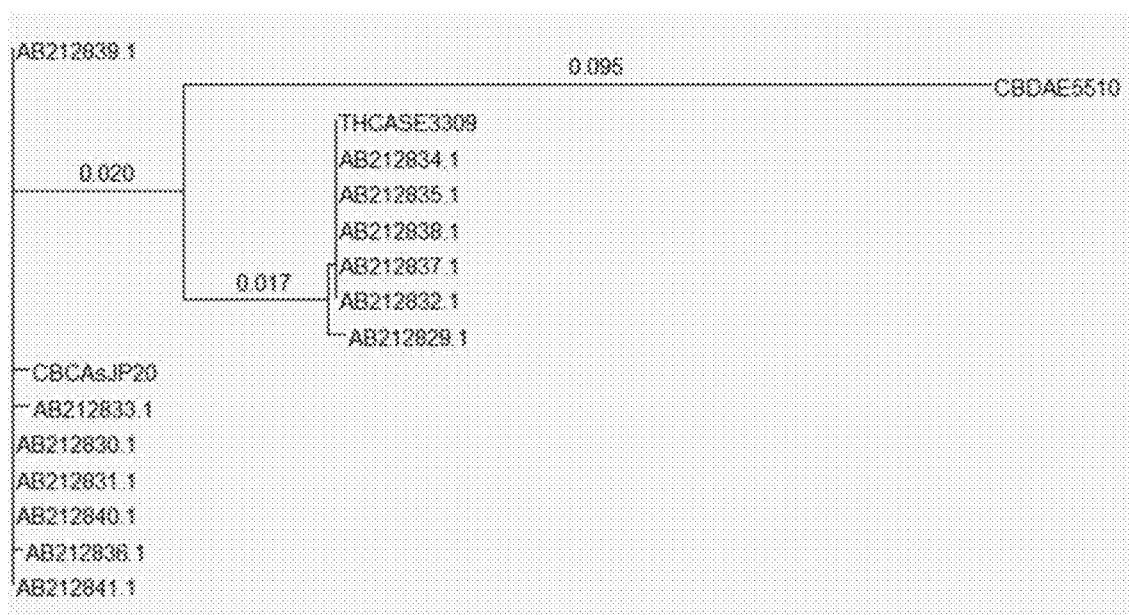
FIG. 4 shows neighbor joining tree for sequences from Kojoma et al. (2006), SEQ ID NO: 1052-SEQ ID NO: 1064 (Table 15), CBDA and THCA from Genbank and CBCA from Page and Stout (2017) (Table 14). Tree was built By Jukes-cantor method. Ranch lengths are marked respectively.

Since no explicit sequence for CBCAS was identified in the completed genome of Purple Kush and no CBCAS accession is currently available in Genbank, the sequence identity of this synthase appears to be unclear in the peer-reviewed literature. Only a recent patent application by Page and Stout (2017; US 2017/0211049 A1) proposed a sequence as shown in FIG. 2. This putative CBCAS sequence exhibits 92.6% amino acid identity to THCAS. In a different study, a set of ambiguously classified cannabinoid synthase DNA sequences have been reported in Kojoma et al (Forensic Sci Int. 2006 Jun. 2; 159(2-3):132-40. Epub 2005 Sep. 6.). Kojoma et al. identifies a series of diverged sequences extracted from different C. sativa strains with ~93.0% identity to other known functional THCAS sequences. Phenotypic data from the respective strains suggested a lack of THCA producing activity. These sequences are known as "Kojoma-type THCAS" sequences and are classified as "defective THCAS alleles". These sequence accessions were collected and a multiple sequence alignment between CBCAS_JP2016 and these sequences from Kojoma et al. revealed 99.0%-99.4% identity between CBCAS_JP2016 and "Kojoma-type THCAS" sequences (FIG. 3). Accordingly, it is contemplated herein that the sequences commonly referred to as "Kojoma-type THCAS" sequences are in fact likely to be CBCAS sequences, rather than defective THCAS sequences. Provided herein, in certain embodiments, is a proposed relationship between the sequences that can be described in a phylogenetic tree, demonstrating 3 clades for the three different synthases (CBDAS, THCAS and CBCAS) (FIG. 4). From the multiple putative alleles of CBCAS, the amino acid substitutions that are unique to the CBCAS clade are provided herein in accordance as set forth in FIG. 3. These clade-specific amino acid substitution sites (n=25) are provided herein as candidates for amino acid sites which are important and unique for this specific synthase function. The amino acid substitutions contemplated herein can be further down-selected to have an effect by referring to homology-based modeling and/or selecting substitutions that change the type of amino acid side chain. In one embodiment, provided herein is a subset of n=14 sites that are contemplated herein to have an effect on CBCAS function: Q31, E40, P46, T74, V90, M163, A255, M288, T290, R294, L318, L391, T448, E495. (Italics represents substitution selected based on homology-based modeling, underline represents site selected both by comparative evolution and by homology-based modeling, while normal font represents candidates only by comparative evolution analysis). Also provided herein are libraries for each of these sites to identify the effect on the CBCAS repertoire for purpose of improvement of industrial biotechnological processes (Table 5).

In some embodiments, a novel cannabinoid synthase (CBDAS) can be created that alters the ratio of the oxidocyclization products. The wild type CBDAS standard oxidocyclization assay with CBGA produces two products as determined by HPLC (15 min), with retention times of approximately 8.84 minutes (an "early product" which is cannabidiolic acid [CBDA]) and 11.46 minutes product which is tetrahydrocannabinolic acid (a "late product") in a ratio of 95% CBDA to 5% THCA FIG. 5b). The 160 CBDAS variants (e.g., "Cannabinoid synthase variants" or variant CBDA synthases) are contemplated herein to produce a spectrum of ratios between CBDA and THCA, or other products. Some variants are contemplated herein to create a greater majority of CBDA and other variants produce a significant greater majority of THCA. In one embodiment, novel variant CBDA synthases are provided herein that alter the ratio of oxidocyclization products in the overall oxidocyclization profile created from CBDAS and using CBGA as a substrate.

It another embodiment, general regions of the protein are altered in order to achieve desired oxidocyclization products from CBGA, and specific amino acid residues to alter are identified to achieve desired oxidocyclization products.

E) Individual select substitutions are combined with other select individual mutation/s to further increase the specific protein activities.

A specific single amino acid substitution that significantly alters the enzyme's functional repertoire is referred to herein as a "preferred substitution." In this embodiment, a novel preferred variant that harbors a single amino acid substitution exhibits a preferred enzyme functional repertoire is further assayed. Multiple preferred substitutions are combined ("stacked") one with another substitution into a doubleton substitution CBDAS variant to create a combined improved effect for further altering and enhancing the variant's enzyme repertoire. A variant enzyme with multiple preferred substitutions is contemplated herein to contain two or more substitutions that affects the same or different component/s of the repertoire (i.e., substrate utilization, product profile).

To further characterize and compare these variant cannabinoid synthase enzymes vs WT cannabinoid synthase, oxidocyclization reaction rates are assessed for the novel cannabinoid synthase variants by employing an enzyme kinetics experimentation. Standard cannabinoid synthase oxidocyclization assays (see above) are prepared for WT cannabinoid synthase and select amino acid substitution variants. Oxidocyclization profiles are measured along a time course spanning from 0 to 20 hours of incubation time with varying CBGA concentrations. At each time point, a 20 uL standard oxidocyclization assay is extracted by ethyl acetate method as described above. To quantify the production of CBDA, THCA, or other cannabinoid at each timepoint, the area under the curve on each HPLC trace is calculated for each peak representing CBDA, THCA, or other cannabinoid (mAU), respectively. Enzyme concentration is estimated by western blot, and by utilizing the product production rate data as a function of substrate concentration, nonlinear curve fitting to the Michaelis-Menten equation will yield Km and Kcat values for each variant enzyme.

Different single specific amino acid substitutions are contemplated herein to alter different aspects of the cannabinoid synthase functional repertoire. For example, several variant amino acid positions or single variant amino acid substitutions could individually, or when combined, alter substrate acceptance in some instances, thus allowing novel substrate usage. Such cannabinoid synthases with these single or combined amino acid substitutions are provided herein (e.g., a variant CBDAS, THCAS or CBCAS). The novel substrate can be a non-naturally occurring substrate or can be a naturally occurring substrate previously not accepted by the cannabinoid synthase.

In another embodiment, several variant amino acid positions or single variant amino acid substitutions could individually, or when combined, change the products generated in an oxidocyclization reaction. In one embodiment, a variant amino acid substitution or substitutions is contemplated herein to cause a variant enzyme to create a product or products that the native cannabinoid synthase does not create. These product/s could be novel or otherwise naturally occurring from other cannabinoid synthases. Such cannabinoid synthases with these single or combined amino acid substitutions are provided herein (e.g., a variant CBDAS, THCAS or CBCAS). In another embodiment, several variant amino acid positions or single variant amino acid substitutions could individually, or when combined, alter the ratio of the oxidocyclization products (e.g., the ratio of CBDA:THCA, such as 100% CBDA/0% THCA, and the like). These cannabinoid synthases with these single or combined amino acid substitutions are provided herein (e.g., a variant CBDAS, THCAS or CBCAS).

Figure 8:
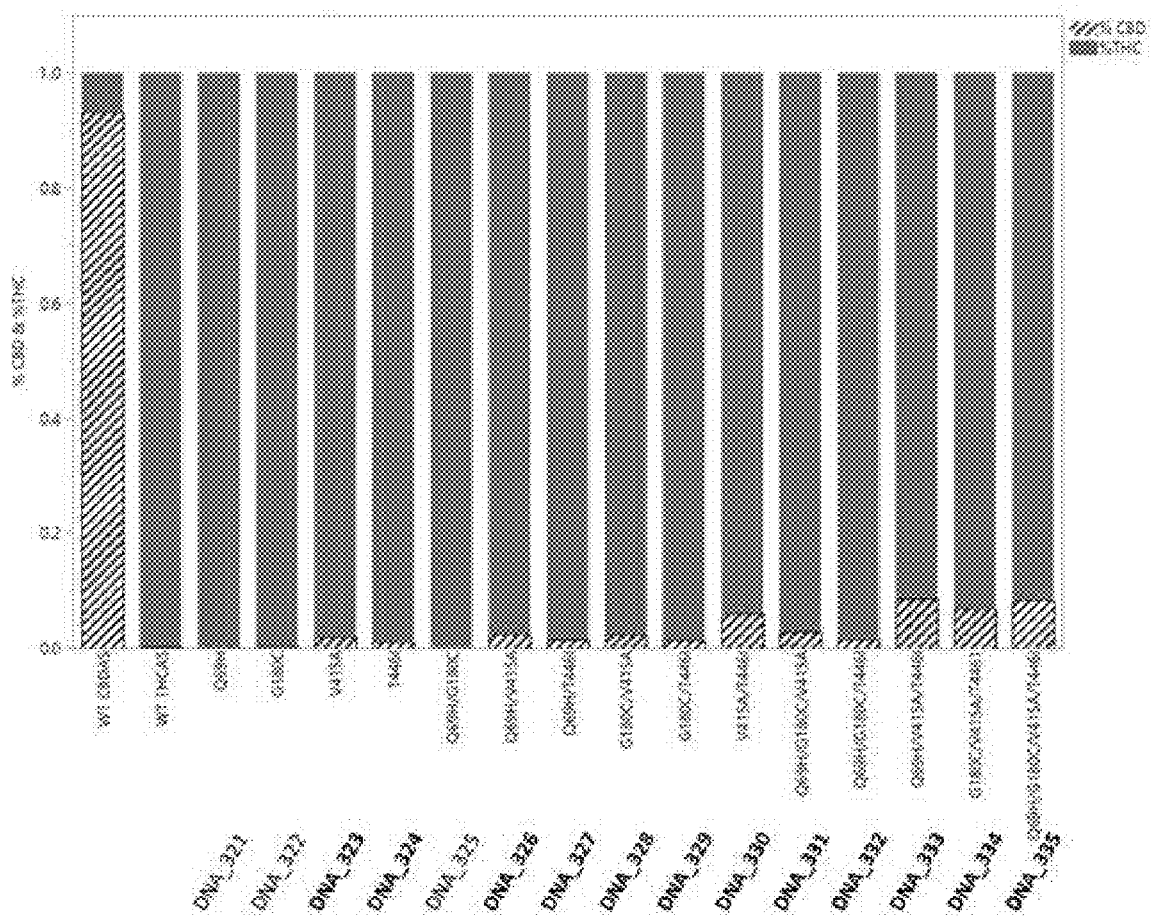
FIG. 8 shows THCA and CBDA production profile for variants of THCAS. Relative proportion of THCA (solid grey bar) and CBDA (diagonal hatch mark bar) is depicted in each bar. The sum of the proportions of the two cannabinoids equals to unity (1.0). The respective amino acid substitutions for each variant are listed below the bars. The sequence ID numbers (SEQ ID NO: 321 to SEQ ID NO:335, which are equivalent to DNA_321 to DNA_335) correlating to Table 3 are labeled across the bottom of the figure. Bold labeled SEQ IDs are those variants that harbor the substitutions V415A and T446I, which are preferred substitutions for altered oxidocyclization profile.

For example, provided here are variant CBDA synthases, wherein said variant is capable of shifting the ratio of CBDA to THCA (CBDA/THCA) to favor production of CBDA (FIG. 8) compared to native consensus CBDA synthase (SEQ ID NO. 1045) or compared to native consensus THCA synthase (SEQ ID NO. 1046). Also provide herein are variant CBDA synthases, wherein said variant is capable of shifting the ratio of THCA to CBDA (THCA/CBDA) to favor production of THCA (FIG. 10) compared to native consensus CBDA synthase or compared to native consensus THCA synthase. Also provided herein are variant THCA synthases, wherein said variant is capable of shifting the ratio of CBDA to THCA (CBDA/THCA) to favor production of CBDA compared to native consensus THCA synthase. Also provided herein are variant THCA synthases, wherein said variant is capable of shifting the ratio of THCA to CBDA (THCA/CBDA) to favor production of THCA compared to native consensus CBDA synthase or compared to native consensus THCA synthase. Also provided herein are variant CBCA synthases, wherein said variant is capable of shifting the ratio of CBCA to THCA (CBCA/THCA) to favor production of CBCA compared to native consensus THCA synthase. Also provided herein are variant CBCA synthases, wherein said variant is capable of shifting the ratio of THCA to CBCA (THCA/CBCA) to favor production of THCA compared to native consensus CBCA synthase or compared to native consensus THCA synthase.

As used herein, the phrase "variant is capable of shifting the ratio of CBDA to THCA (CBDA/THCA) to favor production of CBDA" refers to any cannabinoid synthase variant described herein (e.g. CBDAS, THCAS or CBCAS) that produces a higher percentage of CBDA compared to native consensus CBDA synthase, or in some embodiments when compared to native consensus THCA synthase, using the standard HPLC assay described herein.

As used herein, the phrase "variant is capable of shifting the ratio of THCA to CBDA (THCA/CBDA) to favor production of THCA" refers to any cannabinoid synthase variant described herein (e.g. CBDAS, THCAS or CBCAS) that produces a higher percentage of THCA compared to native consensus THCA synthase, or in some embodiments when compared to native consensus CBDA synthase, using the standard HPLC assay described herein.

As used herein, the phrase "variant is capable of shifting the ratio of CBCA to THCA (CBCA/THCA) to favor production of CBDA" refers to any cannabinoid synthase variant described herein (e.g. CBDAS, THCAS or CBCAS) that produces a higher percentage of CBCA compared to native consensus CBCA synthase, or in some embodiments when compared to native consensus THCA synthase, using the standard HPLC assay described herein.

Described herein, in certain embodiments, are variant CBDA synthase (CBDAS) comprising any combination of one up to all 8 of variant amino acid positions set forth in Table 1, A-H, corresponding to amino acid positons 69, 180, 414, 445, 256, 295, 376 and 377, respectively relative to native consensus CBDA synthase set forth in FIG. 6 (SEQ ID NO: 1049), wherein each amino acid variant is selected from the group consisting of all amino acid variants set forth in Table 1, A-H. In some embodiments, said variant comprises a variant amino acid at a number of variant-positions set forth in Table 1, A-H compared to native consensus CBDA synthase, wherein the number of variant-positions is selected from the group consisting of: 1, 2, 3, 4, 5, 6, 7 and 8. In some embodiments, the variant comprises any combination of one or more selected from the group consisting of: Table 1A position 69 is H69Q; Table 1B position 180 is C180G; Table 1C position 414 is A414V, Table 1D position 445 is I445T; Table 1E position 256 is M256I; Table 1F position 295 is R295K, Table 1G position 376 is Q376K; and Table 1H position 377 is N377K.

In some embodiments, said variant comprises 4 variant amino acids at 4 variant-positions set forth in Table 1, A-H compared to native consensus CBDA synthase, wherein each amino acid variant is selected from the group consisting of all amino acid variants set forth in Table 1, A-H. In some embodiments, said 4 variant positions correspond to Table 1A position 69; Table 1B position 180; Table 1C position 414, and Table 1D position 445. In some embodiments, the variant comprises any combination of one or more selected from the group consisting of: Table 1A position 69 is H69Q; Table 1B position 180 is C180G; Table 1C position 414 is A414V, and Table 1D position 445 is I445T. In some embodiments, the variant comprises the variant amino acids corresponding to: Table 1A position 69 is H69Q; Table 1B position 180 is C180G; Table 1C position 414 is A414V, and Table 1D position 445 is I445T. In some embodiments, said variant comprises 2 variant amino acids at 2 variant-positions set forth in Table 1, A-H compared to native consensus CBDA synthase, wherein each amino acid variant is selected from the group consisting of all amino acid variants set forth in Table 1, A-H. In some embodiments, said 2 variant positions correspond to Table 1C position 414, and Table 1D position 445. In some embodiments, the variant comprises any combination of one or more selected from the group consisting of: Table 1C position 414 is A414V and Table 1D position 445 is I445T. In some embodiments, the variant comprises the variant amino acids corresponding to: Table 1C position 414 is A414V and Table 1D position 445 is I445T.

Described herein, in certain embodiments, are variant cannabidiolic acid (CBDA) synthases or active fragments thereof comprising an amino acid mutation at a position selected from the group consisting of: 69, 414, 180, and 445 relative to a wild-type consensus CBDA synthase set forth in SEQ ID NO: 1046. The amino acid mutation can be any non-naturally occurring amino acid relative to SEQ ID NO: 1046. The mutation can produce an increase yield of a CBDA relative to a wild type CBDA synthase. The increase in yield can be an increase in yield of more than 100%, more than 200%, or more than 300%. The mutation producing the increase in yield can be: a mutation at amino acid position 69 selected from the group consisting of: H69R, H69G, H69K, H69Q, H69A, and H69V, a mutation at amino acid position 414 selected from the group consisting of A414T, A414I, and A414V, or a mutation at amino acid position 445 selected from I445V. The mutation can produce a change in ratio of a first cannabinoid to a second cannabinoid. In one example, a variant CBDA synthase comprising a mutation selected from the group consisting of I445M and I445L can produce an increase in a ratio of CBDA:THCA relative to a wild type CBDA synthase.

In some embodiments, said variant comprises a variant amino acid at 1 variant-position set forth in Table 1, A-H compared to native consensus CBDA synthase, wherein said amino acid variant is selected from the group consisting of all amino acid variants set forth in Table 1, A-H. In some embodiments, said variant position corresponds to a variant position selected from the group consisting of: Table 1C position 414, Table 1D position 445, Table 1F position 295. In some embodiments, said variant position corresponds to a variant position selected from the group consisting of: Table 1C position 414 is A414V; Table 1D position 445 is I445T; and Table 1F position 295 is R295K.

In some embodiments, said variant is capable of shifting the ratio of CBD to THC (CBD/THC) to favor production of CBD (FIG. 8) compared to native consensus CBDA synthase or compared to native consensus THCA synthase.

Further described herein, in certain embodiments, are variant THCA synthase (THCAS) comprising any combination of one up to all 8 of variant amino acid positions set forth in Table 2, A-H, corresponding to amino acid positons 69, 180, 415, 446, 257, 296, 377 and 378, respectively relative to native consensus THCA synthase set forth in FIG. 2, wherein each amino acid variant is selected from the group consisting of all amino acid variants set forth in Table 2, A-H. In some embodiments, said variant comprises a variant amino acid at a number of variant-positions set forth in Table 2, A-H compared to native consensus THCA synthase, wherein the number of variant-positions is selected from the group consisting of: 1, 2, 3, 4, 5, 6, 7 and 8. In some embodiments, the variant comprises any combination of one or more selected from the group consisting of: Table 2A position 69 is Q69H; Table 2B position 180 is G180C; Table 2C position 415 is V415A, Table 2D position 446 is T446I; Table 2E position 257 is I257M; Table 2F position 296 is K296R, Table 2G position 377 is K377Q; and Table 2H position 378 is K378N.

In some embodiments, said variant comprises 4 variant amino acids at 4 variant-positions set forth in Table 2, A-H compared to native consensus THCA synthase, wherein each amino acid variant is selected from the group consisting of all amino acid variants set forth in Table 2, A-H. In some embodiments, said 4 variant positions correspond to Table 2A position 69; Table 2B position 180; Table 2C position 415, and Table 2D position 446. In some embodiments, the variant comprises any combination of one or more selected from the group consisting of: Table 2A position 69 is Q69H; Table 2B position 180 is G180C; Table 2C position 415 is V415A, and Table 2D position 446 is T446I. In some embodiments, the variant comprises the variant amino acids corresponding to: Table 2A position 69 is Q69H; Table 2B position 180 is G180C; Table 2C position 415 is V415A, and Table 2D position 446 is T446I.

In some embodiments, said variant comprises 2 variant amino acids at 2 variant-positions set forth in Table 2, A-H compared to native consensus THCA synthase, wherein each amino acid variant is selected from the group consisting of all amino acid variants set forth in Table 2, A-H. In some embodiments, said 2 variant positions correspond to Table 2C position 415, and Table 2D position 446. In some embodiments, the variant comprises any combination of one or more selected from the group consisting of: Table 2C position 415 is V415A and Table 2D position 446 is T446I. In some embodiments, the variant comprises the variant amino acids corresponding to: Table 2C position 415 is V415A and Table 2D position 446 is T446I.

In some embodiments, said variant comprises a variant amino acid at 1 variant-position set forth in Table 2, A-H compared to native consensus THCA synthase, wherein said amino acid variant is selected from the group consisting of all amino acid variants set forth in Table 2, A-H. In some embodiments, said variant position corresponds to a variant position selected from the group consisting of: Table 2C position 415, Table 2D position 446, Table 2F position 296. In some embodiments, said variant position corresponds to a variant position selected from the group consisting of: Table 2C position 415 is V415A; Table 2D position 446 is T445I; and Table 2F position 296 is K296R.

In some embodiments, said variant is capable of shifting the ratio of CBD to THC (CBD/THC) to favor production of CBD compared to native consensus THCA synthase.

Further described herein, in certain embodiments, are variant THCA synthase relative to native consensus THCA synthase sequence set forth in FIG. 2, wherein the variant THCA synthase is selected from the group of variants set forth in Table 3. Also described herein, are variant CBDA synthase relative to native consensus CBDA synthase sequence CBDAS_E55107.1 set forth in FIG. 6, wherein the variant CBDA synthase is selected from the group of variants set forth in Table 4.

Described herein, in certain embodiments, are variant CBDA synthase (CBDAS) relative to native consensus CBDA synthase sequence CBDAS_E55107.1 set forth in FIG. 6, wherein the variant CBDA synthase comprises any combination of one up to 6 variant amino acids at positions set forth in Table 4, corresponding to amino acid positons 74, 143, 168, 196, 474 and 543, wherein each amino acid variant is selected from the 19 other natural amino acids different from the native amino acid in FIG. 6. In some embodiments, said variant comprises a variant amino acid at a number of variant-positions set forth in Table 4 compared to native consensus CBDA synthase, wherein the number of variant-positions is selected from the group consisting of: 1, 2, 3, 4, 5, and 6. In some embodiments, the variant comprises any combination of one or more selected from the Table 4 group consisting of: T74S, H143R, N168S, N196S, K474Q, and R543H. In some embodiments, the variant further comprises any combination of one up to all 8 of variant amino acid positions set forth in Table 1, A-H, corresponding to amino acid positons 69, 180, 414, 445, 256, 295, 376 and 377, respectively relative to native consensus CBDA synthase set forth in FIG. 6, wherein each amino acid variant at positons 69, 180, 414, 445, 256, 295, 376 and 377 is selected from the group consisting of all amino acid variants set forth in Table 1, A-H, respectively. In some embodiments, said variant comprises a variant amino acid at a number of variant-positions set forth in Table 1, A-H and Table 4 compared to native consensus CBDA synthase, wherein the number of variant-positions is selected from the group consisting of: 1, 2, 3, 4, 5, 6, 7, 8, 9, 10, 11, 12, 13 and 14. In some embodiments, the variant comprises any combination of one or more selected from the group consisting of: Table 1A position 69 is H69Q; Table 1B position 180 is C180G; Table 1C position 414 is A414V; Table 1D position 445 is I445T; Table 1E position 256 is M256I; Table 1F position 295 is R295K, Table 1G position 376 is Q376K; and Table 1H position 377 is N377K; Table 4 T74S; Table 4 H143R; Table 4 N168S; Table 4 N196S; Table 4 K474Q; and Table 4 R543H.

Described herein, in certain embodiments, are variant CBCA synthase (CBCAS) relative to native consensus CBCA synthase sequence CBCAS_JP2016 set forth in FIG. 2, wherein the variant CBCA synthase comprises any combination of one up to all 14 variant amino acid positions in Table 5 corresponding to amino acid positons Q31, E40, P46, T74, V90, M165, A255, M288, T290, R294, L318, L391, T448, E495, wherein each amino acid variant at positons 31, 40, 46, 74, 90, 163, 255, 288, 290, 294, 318, 391, 448 and 495 is selected from the group consisting of all amino acid variants set forth in Table 5, respectively. In some embodiments, the number of variant-positions is selected from the group consisting of: 1, 2, 3, 4, 5, 6, 7, 8, 9, 10, 11, 12, 13 and 14.

Described herein, in certain embodiments, are variant cannabinoid synthase comprising any combination of variant amino acid changes among all polypeptides set forth in Tables 1-5, relative to the respective native cannabinoid synthase set forth in FIG. 2, wherein the amino-acid variants are selected from a combination of a subset of variant amino acids among all variant-positions in polypeptides set forth in Tables 1-5 and conservative substitutions at any amino acid position within wild-type cannabinoid synthase, so long as the variant cannabinoid synthase differs from wild-type cannabinoid synthase by 1 up to 50 amino acids or more. In some embodiments, said variant is capable of shifting the ratio of THC to CBD (THC/CBD) to favor production of THC (FIG. 10) compared to native consensus CBDA synthase or compared to native consensus THCA synthase. In some embodiments, the variant amino acid is at a position selected from the group consisting of: 180, 414 and 445. In some embodiments, the variant amino acid is selected from the group consisting of: C180L, C180R, A414C, A414F, A414H and I445S.

In another embodiment, any one or more of the mutations (variant amino acids at a respective variant position) from any of the "Cannabinoid synthase variants" described herein, can be combined to look for new oxidocyclization profiles, or new ratios between oxidocyclization products (i.e., the ratio between the "early product" and the "late product."). These mutations include any combination of any of the mutations in the "Cannabinoid synthase library," including any one mutation, including any combination of 2 mutations, including any combination of 3 mutations, including any combination of 4 mutations, and including any combination of any number of mutations found in the "Cannabinoid synthase variants."

Described herein, in certain embodiments, are variant cannabidiolic acid synthases or active fragments thereof comprising at least 2 amino acid mutations compared to a wild-type cannabidiolic acid synthase or active fragments thereof. The variant cannabidiolic acid synthase comprising the at least 2 amino acid mutations can be a CBDAS, THCAS, or CBCAS. The variant cannabidiolic acid synthase comprising at least 2 amino acid mutations or active fragment thereof can produce an altered oxidocyclization profile compared to a wild-type cannabidiolic acid synthase or active fragment thereof. For example, the variant cannabidiolic acid synthase comprising at least 2 amino acid mutations or active fragment thereof can act on a substrate to produce an altered amount of a cannabionid relative to an amount of a cannabinoid produced by the wild-type cannabionid synthase or active fragment thereof. The altered amount can be an increase relative to the amount produced by the wild-type cannabinoid synthase, or a decrease relative to the amount produced by the wild-type cannabinoid synthase. The altered amount can produce a change in proportion of a first cannabinoid relative to a second cannabinoid. The increase in amount can be the production of a cannabinoid not produced by the wild type cannabinoid synthase.

A variant CBDAS comprising at least two amino acid mutations can comprise a first mutation at position 69, 414, 180, or 445 relative to a consensus CBDA synthase set forth in SEQ ID NO: 1046. The variant CBDAS comprising at least two amino acid mutations can further comprise a second mutation at position 69, 414, 180, or 445 relative to a consensus CBDA synthase set forth in SEQ ID NO: 1046. The variant CBDAS comprising at least two amino acid mutations can further comprise a third mutation at position 69, 414, 180, or 445 relative to a consensus CBDA synthase set forth in SEQ ID NO: 1046. In some embodiments, the at least two amino acid mutations can comprise a first mutation at position 256, 295, 376, or 377 relative to a consensus CBDA synthase set forth in SEQ ID NO: 1046.

In some embodiments, one of the at least two amino acid mutations is at position 69. At least one of the two mutations can be H69A, H69C, H69D, H69E, H69F, H69G, H69I, H69K, H69L, H69M, H69N, H69P, H69Q, H69R, H69S, H69T, H69V, H69W, or H69Y. At least one of the two mutations can be H69K, H69Q, H69V, or H69G. In some embodiments, one of the at least two amino acid mutations is at position 180. At least one of the two mutations can be C180A, C180D, C180E, C180F, C180G, C180H, C180I, C180K, C180L, C180M, C180N, C180P, C180Q, C180R, C180S, C180T, C180V, C180W, or C180Y. In some embodiments, one of the at least two amino acid mutations is at position 414. At least one of the two mutations can be A414C, A414D, A414E, A414F, A414G, A414H, A414I, A414K, A414L, A414M, A414N, A414P, A414Q, A414R, A414S, A414T, A414V, A414W, and A414Y. At least one of the two mutations can be A414V or A414I. In some embodiments, one of the at least two amino acid mutations is at position 445. At least one of the two mutations can be I445A, I445C, I445D, I445E, I445F, I445G, I445H, I445K, I445L, I445M, I445N, I445P, I445Q, I445R, I445S, I445T, I445V, I445W, or I445Y. At least one of the two mutations can be I445M.

In some embodiments, the at least two amino acid mutations are at a pair of positions selected from the group consisting of: 69/180, 69/414, 69/445, 180/414, 180/445, or 414/445. The at least two amino acid mutations can be A414V/H69K, A414V/H69Q, A414V/H69V, A414V/H69G, A414V/I44M, A414I/H69K, I445M/H69K, or I445M/H69Q. In some embodiments, the at least three amino acid mutations are at a triple of positions selected from the group consisting of: 69/180/441, 69/180/445, 69/414/445, and 180/414/445. The at least three amino acid mutations can be H69Q/A414V/I445M.

Described herein, in certain embodiments, are nucleic acid constructs encoding a variant cannabinoid synthase described herein. The nucleic acid construct can comprise a nucleic acid encoding the variant cannabinoid synthase operably linked to a promoter. The nucleic acid construct can be a DNA or an RNA. Further described herein, in certain embodiments, are vectors comprising the nucleic acid constructs described herein. In some embodiments, the vector is a viral vector or a non-viral vector. In some embodiments, the vector is a viral vector. In some embodiments, the viral vector is a retroviral vector, an adenoviral vector, an adeno associated virus (AAV) vector, an alphavirus vector, a vaccinia virus vector, a herpes simplex virus (HSV) vector, a lentivirus vector, or a retrovirus vector. In some embodiments, the viral vector is an adeno associated virus (AAV) vector. In some embodiments, the adeno associated viral vector is AAV1, AAV2, AAV3, AAV4, AAV5, AAV6, AAV7, or AAV8. In some embodiments, the viral vector is a replication-competent viral vector or a replication-incompetent viral vector. In some embodiments, the non-viral vector is a plasmid, a naked nucleic acid, or nucleic acid complexed with a delivery vehicle. In some embodiments, the plasmid is complexed with a delivery vehicle. In some embodiments, the delivery vehicle is a lipid. In some embodiments, the lipid is a liposome.

Further described herein, in certain embodiments, are microorgansims comprising the nucleic acid constructs described herein. The microorganism can be a yeast. The yeast can be a *Saccharomyces cerevisiae*. The microorganism can be a bacterium. The bacterium can be an *Escherichia coli*. The microorganism can comprise a vector comprising a nucleic acid construct encoding a variant cannabinoid synthase described herein.

Further described herein, in certain embodiments, are plants comprising the nucleic acid constructs encoding the variant cannabinoid synthases described herein. The plant can be a vascular plant. The vascular plant can be a plant in the family Cannabaceae. The plant can be a plant in the genus *Cannabis*. The plant in the genus *Cannibis* can be a plant selected from the group consisting of *Cannabis satvia*, *Cannabis indica*, and *Cannabis ruderalis*. The plant can be a non-vascular plant. The non-vascular plant can be an algae. The algae can be a microalgae. The nucleic acid encoding a variant cannabinoid synthase can be integrated into the genome of the plant. The nucleic acid encoding a variant cannabinoid synthase can be a vector.

Further described herein, in certain embodiments, are recombinant methods of producing a variant cannabinoid synthase comprising expressing the nucleic acid constructs described herein. In some embodiments, producing a variant cannabinoid synthase comprise: (i) contacting a cell with a nucleic acid construct encoding the variant cannabinoid synthase, and (ii) expressing the variant cannabinoid synthase in the cell. The contacting can occur in vivo. The contacting can occur ex vivo. In some embodiments, the method comprises expanding the cell to produce a plurality of expanded cells. In some embodiments, the expanding occurs in a bioreactor. In some embodiments, the bioreactor is a stirred suspension bioreactor. The method can further comprise isolating and purifying the variant cannabinoid synthase from the cell or the plurality of expanded cells. The cell can be a plant cell or a microorganism cell. The contacting can comprise delivering the nucleic acid construct or a vector comprising the nucleic acid construct into the cell. The delivering can comprise microinjection, liposome-mediated transfection, electroporation, or nucleofection of the nucleic acid construct or vector comprising the nucleic acid construct into the microorganism. In some embodiments, the method comprises integrating the nucleic acid construct encoding the variant cannabinoid synthase into the genome of the cell.

Described herein, in certain embodiments, are methods of producing a cannabinoid, comprising: (i) contacting a cell with a nucleic acid construct encoding the variant cannabinoid synthase, (ii) expressing the variant cannabinoid synthase, and (iii) isolating a cannabinoid produced by the cell. In some embodiments, the method comprises expanding the cell to produce a plurality of expanded cells. In some embodiments, the expanding occurs in a bioreactor. In some embodiments, the bioreactor is a stirred suspension bioreactor. The method can further comprise isolating and purifying the cannabinoid from the cell or the plurality of expanded cells. The cell can be a plant cell or a microorganism cell. The contacting can occur in vivo. The contacting can occur ex vivo. The contacting can comprise delivering the nucleic acid construct or a vector comprising the nucleic acid construct into the cell. The delivering can comprise microinjection, liposome-mediated transfection, electroporation, or nucleofection of the nucleic acid construct or vector comprising the nucleic acid construct into the microorganism. In some embodiments, the method comprises integrating the nucleic acid construct encoding the variant cannabinoid synthase into the genome of the cell. Described herein, in certain embodiments, are methods of producing a cannabinoid, comprising: introducing a variant cannabinoid synthase described herein to a substrate of the variant cannabinoid synthase. In some embodiments, the substrate is a non-naturally occurring substrate described herein.

In some embodiments, libraries of mutations cannabinoid synthases are provided, and screened to identify un-natural novel protein variant cannabinoid synthases that broaden the ranges of these basic functional aspects of cannabinoid synthase and allow control of cannabinoid synthesis that can produce specific small molecules at desired ratios (e.g., the desired ratio of CBDA to THCA, and the like). Expressing a soluble variant cannabinoid synthases that performs the same biochemical task as the native cannabinoid synthase, is useful in expressing the phytocannabinoid biosynthesis pathway exogenously in a microorganism. This permits for the expression of the most desirable cannabinoids, including non-abundant phytocannabinoids, at an industrial scale and in pure form to enable development of these phytocannabinoids into human therapeutics.

In one embodiment, exemplary variant cannabinoid synthases have the amino acid sequences derived by translation of SEQ ID NO:DNA0001-DNA0678, corresponding to SEQ ID NO:1 through SEQ ID NO: 678, and combining any mutation found, but not limited to those set forth, in SEQ ID NO: DNA0001-DNA0678. As used herein, "protein variant" refers to an open reading frame with substitutions of amino acid residues relative to WT. Examples of protein variants include the substitution of one hydrophobic residue such as isoleucine, valine, leucine or methionine for another; or the substitution of one polar residue for another, such as the substitution of arginine for lysine, glutamic for aspartic acids, or glutamine for asparagine, and the like. Other illustrative examples of protein variant substitutions include the changes of: alanine to serine; arginine to lysine; asparagine to glutamine or histidine; aspartate to glutamate; cysteine to serine; glutamine to asparagine; glutamate to aspartate; glycine to proline; histidine to asparagine or glutamine; isoleucine to leucine or valine; leucine to valine or isoleucine; lysine to arginine, glutamine, or glutamate; methionine to leucine or isoleucine; phenylalanine to tyrosine, leucine or methionine; serine to threonine; threonine to serine; tryptophan to tyrosine; tyrosine to tryptophan or phenylalanine; valine to isoleucine or leucine, and the like. The term "protein variant" also includes the use of a substituted amino acid in place of an unsubstituted amino acid.

Modifications and substitutions contemplated herein are not limited to replacement of amino acids. For a variety of purposes, such as increased stability, solubility, or configuration concerns, one skilled in the art will recognize the need to introduce other modifications (e.g., by deletion, replacement, or addition). Examples of such other modifications include incorporation of rare amino acids, dextra-amino acids, glycosylation sites, cytosine for specific disulfide bridge formation. The modified peptides can be chemically synthesized, or the isolated gene can be site-directed mutagenized, or a synthetic gene can be synthesized and expressed in bacteria, yeast, microalgae, baculovirus, any micro-organism or tissue culture, and the like.

Novel cannabinoid synthases that have less than 99% sequence identity with the native consensus amino acid sequence (set forth in SEQ ID AA_consensus) are un-natural cannabinoid synthases, also referred to herein as non-naturally occurring cannabinoid synthases. Sequence homology and identity are often measured using sequence analysis software (e.g., Sequence Analysis Software Package of the Genetics Computer Group, University of Wisconsin Biotechnology Center, 1710 University Avenue, Madison, Wis. 53705). The term "non-identity" in the context of two or more nucleic acids or polypeptide sequences, refers to two or more sequences or subsequences that have a specified percentage of amino acid residues or nucleotides that are not the same when compared and aligned for maximum correspondence over a comparison window or designated region as measured using any number of sequence comparison algorithms or by manual alignment and visual inspection. The term "non-homology" in the context of two or more nucleic acids or polypeptide sequences, refers to two or more sequences or subsequences that are non-homologous or have a specified percentage of amino acid residues or nucleotides that are non-homologous when compared and aligned for maximum correspondence over a comparison window or designated region as measured using any number of sequence comparison algorithms or by manual alignment and visual inspection. Programs referred to hereinabove allow for substitution of an amino acid with a similar amino acid by determining a degree of homology between the sequences being compared.

Lengthy table referenced here

US11920166-20240305-T00001

Please refer to the end of the specification for access instructions.

Lengthy table referenced here

US11920166-20240305-T00002

Please refer to the end of the specification for access instructions.

Lengthy table referenced here

US11920166-20240305-T00003

Please refer to the end of the specification for access instructions.

Lengthy table referenced here

US11920166-20240305-T00004

Please refer to the end of the specification for access instructions.

Lengthy table referenced here

US11920166-20240305-T00005

Please refer to the end of the specification for access instructions.

Lengthy table referenced here

US11920166-20240305-T00006

Please refer to the end of the specification for access instructions.

Lengthy table referenced here

US11920166-20240305-T00007

Please refer to the end of the specification for access instructions.

Lengthy table referenced here
US11920166-20240305-T00008

Please refer to the end of the specification for access instructions.

Lengthy table referenced here
US11920166-20240305-T00009

Please refer to the end of the specification for access instructions.

Lengthy table referenced here
US11920166-20240305-T00010

Please refer to the end of the specification for access instructions.

Lengthy table referenced here
US11920166-20240305-T00011

Please refer to the end of the specification for access instructions.

Lengthy table referenced here
US11920166-20240305-T00012

Please refer to the end of the specification for access instructions.

Lengthy table referenced here
US11920166-20240305-T00013

Please refer to the end of the specification for access instructions.

Lengthy table referenced here
US11920166-20240305-T00014

Please refer to the end of the specification for access instructions.

Lengthy table referenced here
US11920166-20240305-T00015

Please refer to the end of the specification for access instructions.

EXAMPLES

Materials and Methods

Library Construction: Libraries are constructed of novel variants of CBDAS, THCAS and CBCAS based on novel amino acid substitutions and new combinations of natural amino acid substitutions. These novel variants are screened and investigated for altered enzyme repertoire. THCAS diverges from CBDAS, for example, at n=83 amino acid positions (FIG. 2). A rational enzyme engineering approach was employed to identify amino acid positions with putative functional effects on synthase activity using homology-based protein structure modeling for CBDAS and CBCAS compared to the reported THCAS crystal structure (Protein Data Bank ID code 3VTE) in addition to comparative evolutionary analysis. In another embodiment, an approach to investigate all divergent sites for all possible amino acids can be employed. This would result in a library matrix of size of 1660 variants (83sites×20amino acids=1660).

The following are the libraries designed in the invention:

Example 1

CBDAS site-saturation amino acid substitutions library: This library was created to identify a significantly improved CBDAS. The improved CBDAS enzyme exhibits improved enzyme kinetics, and/or improved/altered product profile and/or novel acceptance of substrate/s not accepted by the consensus native synthase. Based on this homology-based protein modeling, the active site of CBDAS was shown to exhibit four amino acid differences from THCAS in the "deep active site" near the catalytic FAD cofactor. [Note: A multiple alignment of the complete amino acid sequences between CBDAS and THCAS displayed an insertion/deletion event at alignment position 253. Accordingly, THCAS displays a Serine (S) insertion at alignment site 253 (see FIG. 2). It follows that all homologous amino acid positions $\geq$=253 through 544 on CBDAS, respectively correlated to the homologous positions $\geq$=254 through 545 on THCAS]. The identified divergent amino acids in the "deep active site" were as follows (according to standard IUPAC notation, the CBDAS residue is listed first, the CBDAS amino acid position is listed second, while the homologous THCAS residue is listed last): H69Q, C180G, A414V (homologous to amino acid position 415 in THCAS), and I445T (homologous to amino acid position 446 in THCAS). Four additional changes were also identified in the "outer pocket" of CBDAS relative to THCAS. The positions of these substitutions on CBDAS are M256I, R295K, Q376K, and N377K. Variant cannabinoid synthases with amino acid substitutions at these 8 sites were produced and assayed to explore the effect of amino acid diversity on synthase function. Accordingly, each of the 8 positions was substituted with the other 19 amino acids. First, (8sites×20amino acids) n=160 deoxyribonucleic acid (DNA) sequences are generated based on a WT consensus DNA sequence of the open reading frame for native CBDAS (CBDAS DNA_consensus; SEQ ID NO: 1049; FIG. 6) including DNA mutations that translate into a single novel amino acid substitution for each protein variant. These n=160 CBDAS variants were labeled SEQ ID NO: 1-SEQ ID NO: 160, and are described in Table 1. After signal peptide cleavage these variants express as a ~60 kDa soluble, monomeric protein with 522 residues (including 6 residues for HIS-tag labeling) and were purified by metal affinity chromatography. To assess enzyme activity of these CBDAS variants, the purified recombinant protein was incubated with CBGA, and reaction products were analyzed by HPLC to determine whether the respective CBDAS variants show a difference in efficiency and/or kinetics of oxidocyclization conversion of CBGA and/or a change in the oxidocyclization product profile (i.e. % CBDA vs. % THCA or production of other cannabinoids). CBDAS variants having a difference in efficiency and/or kinetics of oxidocyclization conversion of CBGA and/or a change in the oxidocyclization product profile (i.e. % CBDA vs. %

THCA or production of other cannabinoids) were isolated and provided as CBDAS variants.

Variant CBDA Synthase HPLC Assay

Figure 9A:
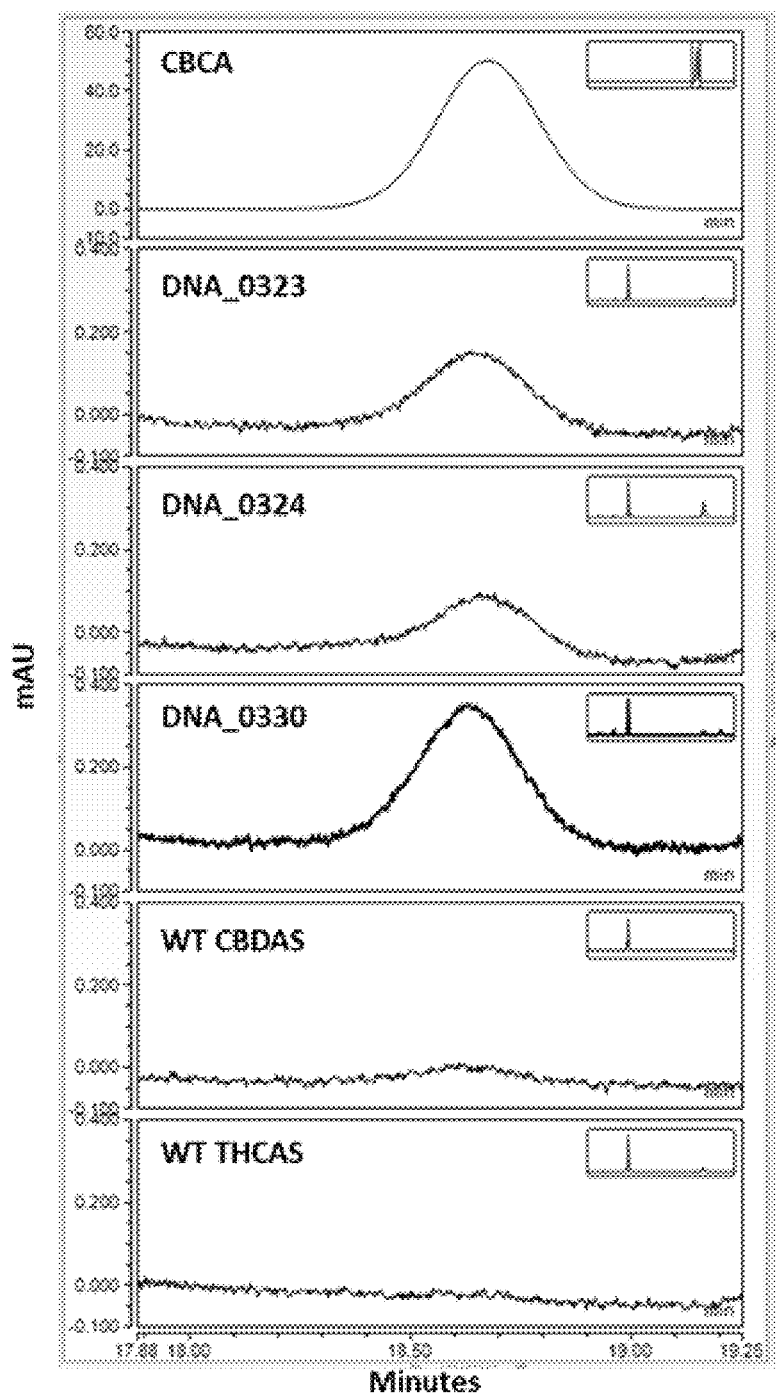
FIG. 9A shows de novo CBCA production by THCAS variants. HPLC traces for CBCA produced by select variants that display the highest detectible level of CBCA production, also including respective traces for WT THCAS, WT CBDAS and CBCA standard reference.
Figure 9B:
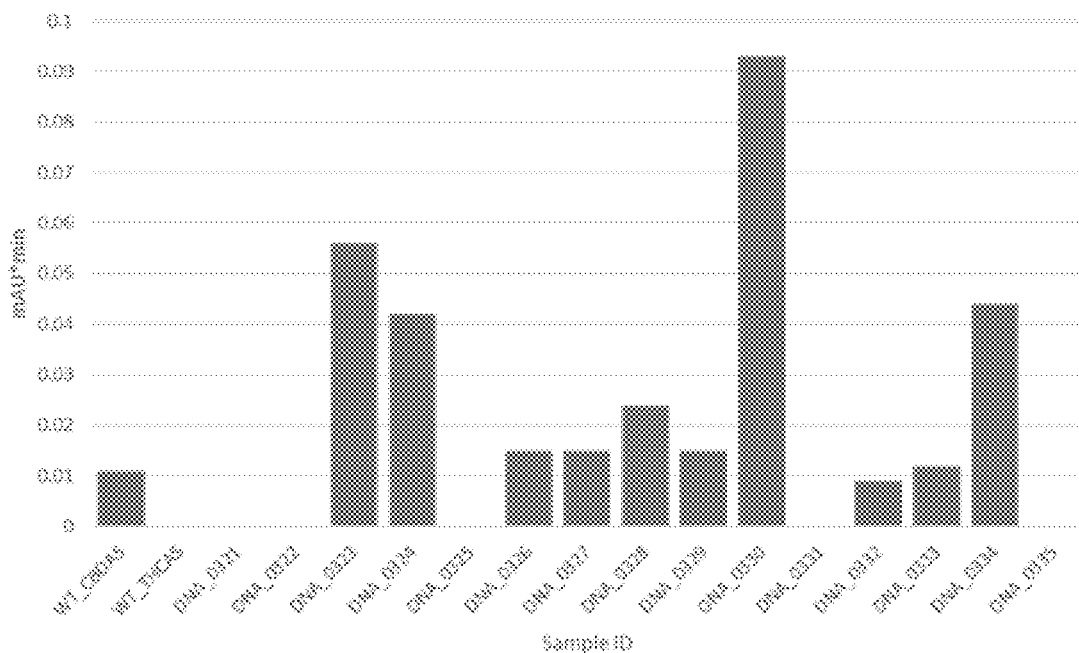
FIG. 9B shows de novo CBCA production by THCAS variants. Quantitative HPLC peak integration values (for area under the curve) for CBCA peak eluting at ~18.6 minutes, corresponding to CBCA standard.
Figure 10:
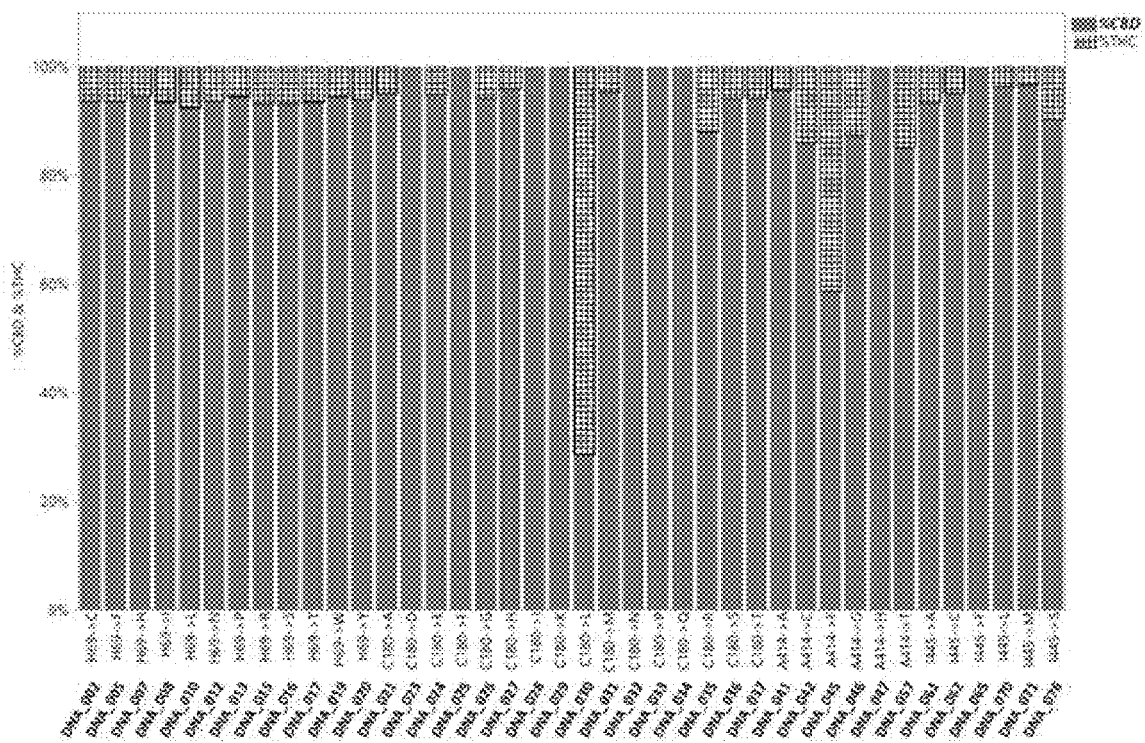
FIG. 10 shows THCA and CBDA production profile for select variants of CBDAS. Relative proportion of CBDA (solid grey bar) and THCA (checkered hatch mark bar) is depicted in each bar. The sum of the proportions of the two cannabinoids equals to unity (1.0). The respective amino acid substitutions for each variant are listed below the bars. The sequence ID numbers (SEQ ID NO) correlating to Table 1 are labeled across the bottom of the figure.
Figure 11:
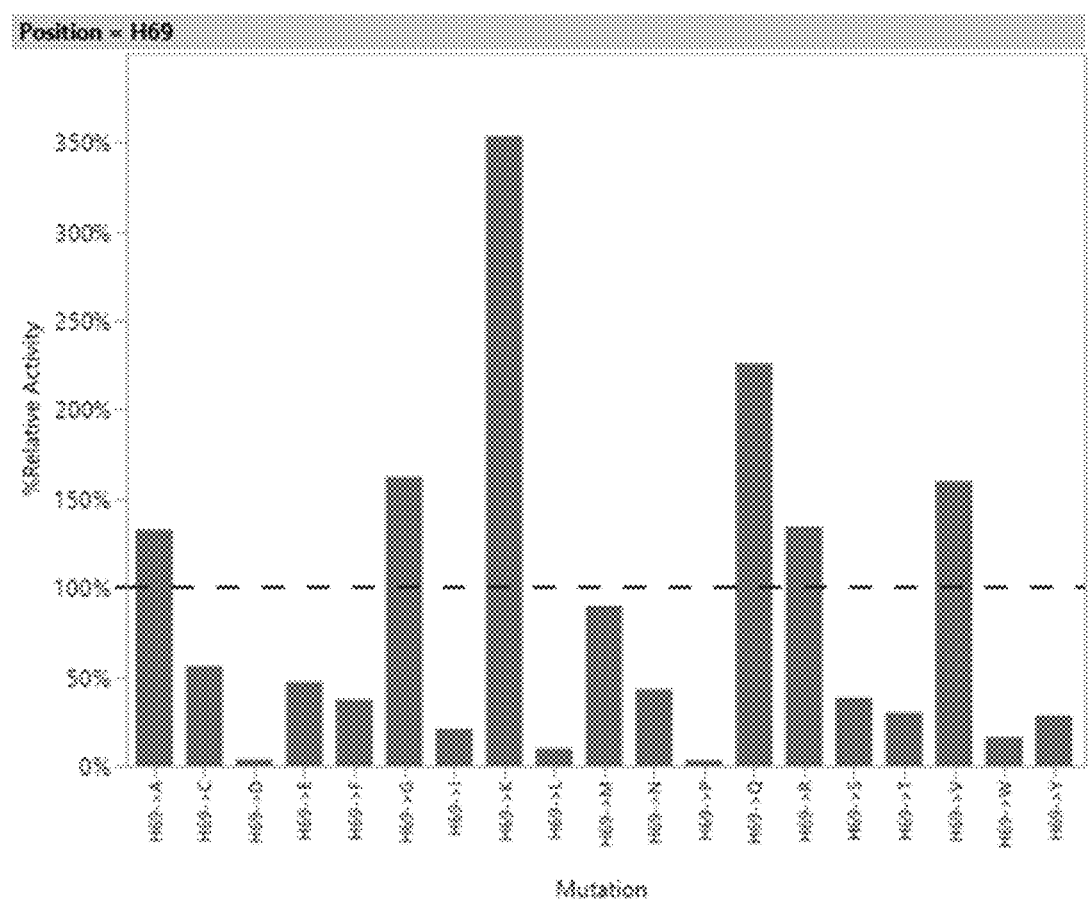
FIG. 11 illustrates relative activity of CBDA synthase site H69 site saturation mutants compared to a wild type CBDA synthase.
Figure 12:
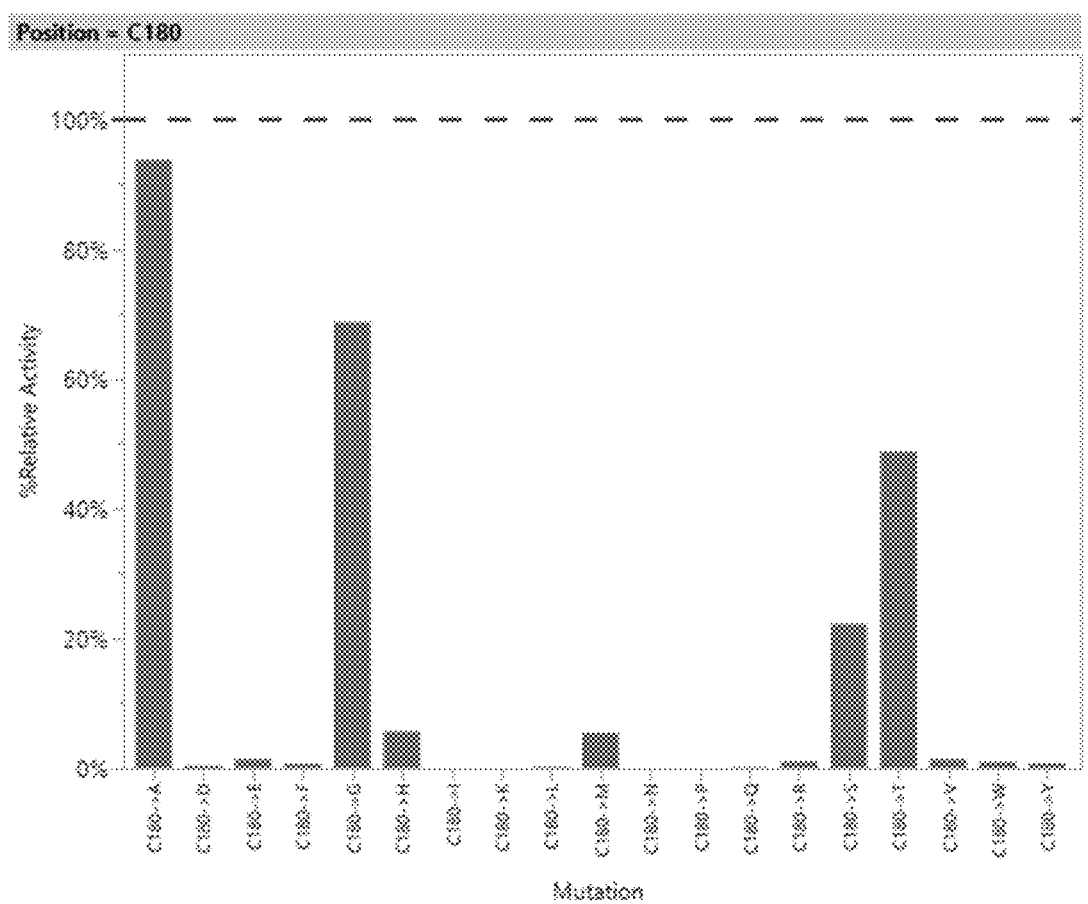
FIG. 12 illustrates relative activity of CBDA synthase site C180 site saturation mutants compared to a wild type CBDA synthase.
Figure 13:
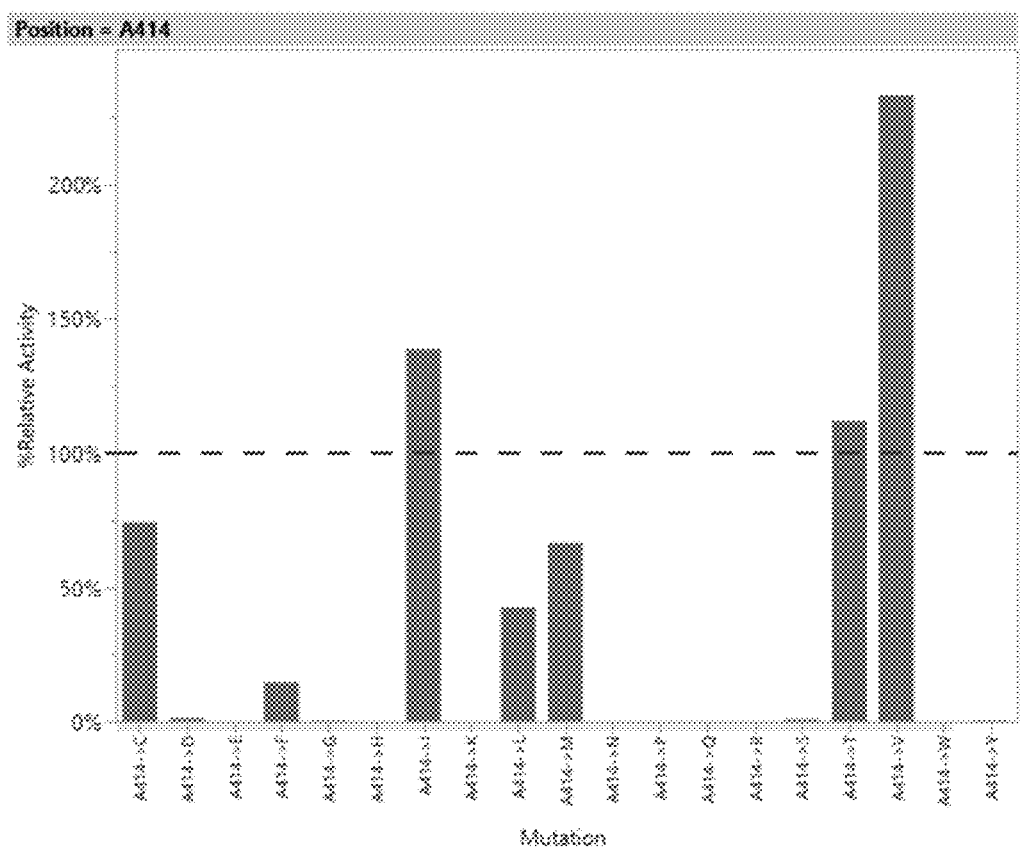
FIG. 13 illustrates relative activity of CBDA synthase site A414 site saturation mutants compared to a wild type CBDA synthase.
Figure 14:
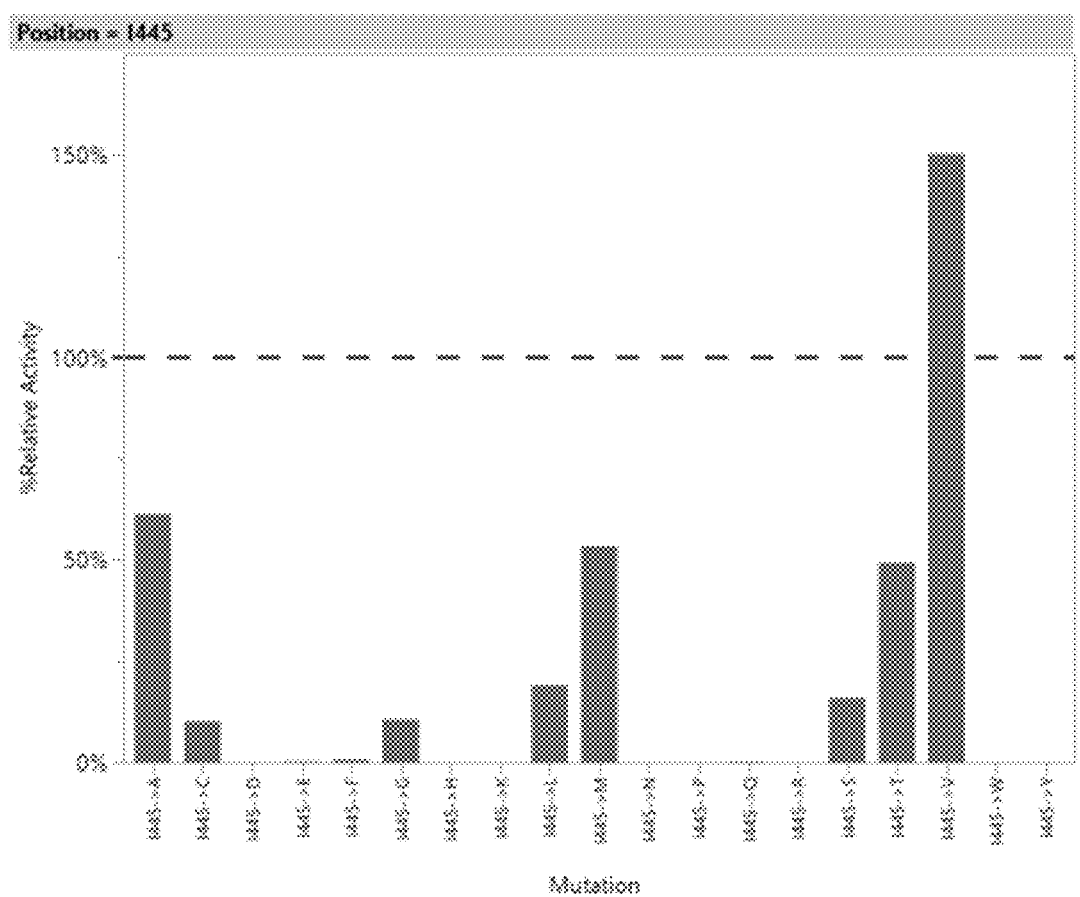
FIG. 14 illustrates relative activity of CBDA synthase site I445 site saturation mutants compared to a wild type CBDA synthase.

HPLC data was generated for a subset of CBDAS variants from Table 1 described in Example 1. Experimental results demonstrated that novel CBDAS variants were generated demonstrating altered oxidocyclization product profiles (FIG. 10). Specifically, select new variants were shown to produce varying proportions of CBDA and THCA compared to WT. While WT CBDA produced a majority of CBDA and a minority of THCA (6.8%; FIG. 9), some new CBDAS variants provided herein produced significantly more THCA (9.8%-71.8%) and some variants produce minimal amounts of THCA (FIG. 10 and Table 7; Table 8 and FIGS. 11-14). Therefore, it was demonstrated that rationally designed amino acid substitutions in a cannabinoid synthase can significantly alter the oxidocyclization product profiles and proportion of cannabinoids produced. These novel cannabinoid synthase enzymes were contemplated herein to be used for improved cannabinoid synthase performance in biopharmaceutical or agricultural applications. Specifically, current data demonstrated that substitutions at CBDAS amino acid positions 180, 414 and 445 have significant effect to increase THCA production. Alternatively, other substitutions at these same amino acid positions can significantly decrease THCA production by CBDAS variants. Thus, those of skill in the art are able to combine multiple preferred amino substitutions provided herein to create altered product profile and improved enzyme efficiency, as desired. Such combined variants will allow the creation of novel and superior cannabinoid synthase enzymes for biopharmaceutical or agricultural applications.

Example 2

THCAS site-saturation amino acid substitutions library: This library is created to identify a significantly improved THCAS. The improved THCAS enzyme exhibits improved enzyme kinetics, and/or improved/altered product profile and/or novel acceptance of substrate/s not accepted by the consensus synthase. This second library is constructed using the same methods as described above for CBDAS to explore diversity in THCAS product profile. We have identified n=8 amino acid positions in THCAS: (i.e. Q69, G180, V415, T446, I257, K296, K377, and K378) for us in producing variant THCA synthases. A library is created to determine the effect of amino acid diversity by replacing at each of the 8 positions, the other 19 amino acids. First, (8sites×20amino acids) n=160 (8×20) 160 deoxyribonucleic acid (DNA) sequences are generated based on a WT consensus DNA sequence of the open reading frame for native THCAS (THCAS DNA_consensus; SEQ ID NO: 1050; FIG. 7) including DNA mutations that translate into a single novel amino acid substitution for each protein variant. These n=160 THCAS variants are labeled SEQ ID NO:161-SEQ ID NO: 320 (Table 2). After signal peptide cleavage these variants express as a ~60 kDa soluble, monomeric protein with 520 residues (including 6 residues for HIS-tag labeling) and are purified by metal affinity chromatography. To assess enzyme activity of these THCAS variants, the purified recombinant protein is incubated with CBGA and reaction products are analyzed by HPLC to determine whether the respective THCAS variants demonstrate a difference in efficiency and/or kinetics of oxidocyclization conversion of CBGA and/or a change in the oxidocyclization product profile (i.e. % CBDA vs. % THCA or production of other cannabinoids, such as CBCA). THCAS variants having a difference in efficiency and/or kinetics of oxidocyclization conversion of CBGA and/or a change in the oxidocyclization product profile (i.e. % CBDA vs. % THCA or production of other cannabinoids, such as CBCA) are isolated and provided as THCAS variants.

Example 3

THCAS combinatorial amino acid substitution library to convert THCAS to a CBDAS: This library was created to identify a significantly improved CBDAS by converting a native THCAS into a CBDAS. The improved CBDAS enzyme exhibits improved enzyme kinetics, and/or improved/altered product profile. The third library was constructed by specific substitutions at the deep active site amino acid positions to convert THCAS to a novel and improved synthase that produces CBDA. The 4 amino acid positions in the deep active site were mutated to the corresponding CBDAS amino acid. These substitutions were Q69H, G180C, V415A, and T446I. These variants consisted of all possible combinations of single, double, triple, and quadruple substitutions resulting in 15 THCAS variants corresponding to SEQ ID NO: SEQ ID NO: 321 to SEQ ID NO: 335, set forth in Table 3. To assess enzyme activity of these THCAS variants, the purified recombinant protein were incubated with CBGA and reaction products were analyzed by HPLC to determine whether the respective THCAS variants showed a difference in efficiency and/or kinetics of oxidocyclization conversion of CBGA and/or a change in the oxidocyclization product profile (% CBDA or % CBDA vs. % THCA or production of other cannabinoids). THCAS variants having a difference in efficiency and/or kinetics of oxidocyclization conversion of CBGA and/or a change in the oxidocyclization product profile (i.e. % CBDA vs. % THCA or production of other cannabinoids, such as CBCA) were isolated and provided as THCAS variants.

Variant THCA Synthase HPLC Assay

HPLC data was generated as set forth above in Example 3 for all THCA synthase variants from Table 3. The experimental results demonstrated that THCAS variants were created with altered oxidocyclization product profiles. Specifically, select new variants were shown to produce significantly increased proportions of CBDAS (up to 8.59% CBDAS), while WT THCAS produced only a negligible proportion of CBDAS (0.0%-0.25% CBDAS) (FIG. 8; Table 6). In addition to the increased production of CBDAS, some select variants exhibited novel production of CBCAS (albeit in fairly low amounts), while WT THCAS did not produce any detectable amount of CBCAS (FIG. 9; Table 7). Comparison of the four singleton mutation variants indicated that enzymes derived from SEQ ID NO: 323 (V415A) and SEQ ID NO: 324 (T446I) produced a higher proportion of CBDAS compared to enzymes derived from SEQ ID NO: 321 (Q69H) and SEQ ID NO: 322 (G180C). The underlying mutations at V415A and T446I were preferred substitutions and these amino acid position sites were rationally identified candidates for site saturation mutagenesis library screening. Variant cannabinoid synthases (e.g., THCA synthases or CBDA synthases) that included unnaturally occurring substitutions at these two sites (V415 and T446) were provided herein as improved cannabinoid synthases. From the results obtained herein shown in FIG. 8, variant SEQ ID NO: 330, it was contemplated that stacking these two preferred amino acid substitutions would have a synergistic effect to increase the proportion of CBDAS production to a proportion that is greater than either mutation's effect independently (see, e.g., FIG. 8, variant SEQ ID NO: 330). Accordingly, provided herein are novel cannabinoid synthase (e.g., CBDAS, THCAS or CBCAS) variants that include combinations of two or more substitutions across sites 415 and 446. Furthermore, these same preferred amino acid substitutions (i.e. V415A and T446I) appeared to cause de novo production of CBCA (while WT THCAS does not produce any detectible amount of CBCAS) (FIG. 9). It was contemplated herein to determine the effect of different amino acid substitutions at these two sites (i.e. V415A and T446I) for altered oxidocyclization product profiles specifically related to both CBDA and CBCA.

Example 4

CBDAS combinatorial amino acid substitution library using natural substitution of native CBDAS: This library is created to identify a significantly improved CBDAS. The improved variant CBDAS enzyme exhibits improved enzyme kinetics, and/or improved/altered product profile and/or novel acceptance of substrate/s not accepted by the consensus CBDAS synthase. The fourth library is constructed to assay novel combinations of natural substitutions of native CBDAS. Theses substitutions are not present in SEQ ID NO: CBDAS_E551071 (SEQ ID NO: 1043), yet are found in nature on other functional alleles of CBDAS. It is contemplated that an optimal combination of natural substitutions provides a novel CBDAS variant not found in nature with an improved enzyme functional repertoire, e.g., showing a difference in efficiency and/or kinetics of oxidocyclization conversion of CBGA and/or a change in the oxidocyclization product profile (% CBDA or % CBDA vs. % THCA or production of other cannabinoids). CBDAS variants having a difference in efficiency and/or kinetics of oxidocyclization conversion of CBGA and/or a change in the oxidocyclization product profile (i.e. % CBDA vs. % THCA or production of other cannabinoids, such as CBCA) are isolated and provided as CBDAS variants. In another embodiment, the variant amino acids in variant CBDAS having natural amino acid substitutions are combined with novel substitutions found in other libraries described herein to further improve product specificity. It is contemplated herein that such a combined enzyme with multiple substitutions is a significantly improved novel variant enzyme optimized for industrial production of cannabinoids. Sequence heterogeneity amongst CBDAS sequences from multiple strains of "drug type" and "fiber type" plants revealed polymorphisms among CBDAS sequences. Six (n=6) amino acid positions in CBDAS were identified as polymorphic sites that retained a functional CBDAS. The natural substitutions identified at these positions were T74S, N168S, N196S, K474Q, R543H, and H143R A library of variants is constructed with all possible single, double, triple, quadruple, quintuple, and sextuple combinations (respectively, n=6+15+20+15+6+1=63). These variants are created on the sequence backbone of CBDAS_DNA_consensus (SEQ ID NO: 1046; correlating to amino acid CBDAS_E551071; FIG. 2). This yields n=63 CBDAS variants SEQ ID NO: 336 to SEQ ID NO: 398 (Table 4). To assess enzyme activity of these CBDAS variants, the purified recombinant protein are incubated with CBGA and reaction products are analyzed by HPLC to determine whether the respective CBDAS variants show a difference in efficiency and/or kinetics of oxidocyclization conversion of CBGA and/or a change in the oxidocyclization product profile (% CBDA vs. % THCA or production of other cannabinoids). CBDAS variants having a difference in efficiency and/or kinetics of oxidocyclization conversion of CBGA and/or a change in the oxidocyclization product profile (i.e. % CBDA vs. % THCA or production of other cannabinoids) are isolated and provided as CBDAS variants.

Example 5

CBCAS site saturation amino acid substitution library: This library is created to identify a significantly improved CBCAS. The variant CBCAS enzyme exhibits improved enzyme kinetics, and/or improved/altered product profile and/or novel acceptance of substrate/s not accepted by the consensus synthase. The fifth library is constructed based on putatively functional amino acid sites (n=14) in CBCAS that have been identified by combined comparative evolutionary analysis and homology-based modeling. Each site is altered to all remaining natural alternative amino acid substitutions (n=19) using as a template for the consensus natural sequence the SEQ ID NO: CBCAS_JP2016 (FIG. 2)_JP2016 (SEQ ID NO: 1045). Ibis results in screening of 20 variants per site. The resultant n=280 DNA sequences are presented in Table 5 (SEQ ID NO: 399 to SEQ ID NO: 678)). To assess enzyme activity of these CBCAS variants, the purified recombinant protein are incubated with CBGA and reaction products are analyzed by HPLC to determine whether any of the respective CBCAS variants show an altered oxidocyclization conversion of CBGA to CBCA and/or a change in the oxidocyclization product profile (for example % THCAS vs. % CBCAS or production of other natural or novel cannabinoids). CBCAS variants having an altered oxidocyclization conversion of CBGA to CBCA and/or a change in the oxidocyclization product profile (for example % THCAS vs. % CBCAS or production of other natural or novel cannabinoids) are isolated and provided herein.

Example 6

The cannabinoid synthase variants are studied as follows:
A) Construction of a synthesized gene library of (A) n=160 CBDAS variants with select amino acid substitutions as described in EXAMPLE 1 (B) n=160 THCAS variants with select amino acid substitutions as described in EXAMPLE 2, (C) n=15 THCAS convert into CBDAS variants as described in EXAMPLE 3, (D) the (63) novel natural combinatorial variants of CBDAS based on natural amino acid substitutions as described in EXAMPLE 4 and (E) n=28 CBCAS variants with site saturation at 14 select sites as described in EXAMPLE 5.

DNA primers are designed, ordered and synthesized, that allow site-directed mutagenesis in a *Saccharomyces cerevisiae* yeast protein expression plasmid encoding the native cannabinoid synthases (THCAS DNA_consensus (SEQ ID NO: 1047), CBDAS_DNA_consensus (SEQ ID NO: 1046), and CBCAS_DNA_consensus (SEQ ID NO:1048)). Agilent "Quik Change II Site-Directed Mutagenesis Kit (#2000523) is used to create variants of cannabinoid synthases. The sequences for the cannabinoid synthases variants are set forth in the Tables herein as SEQ ID NO: 1 to SEQ ID NO:678 (which are also referred to herein as DNA_0001 to DNA_0678). Each cannabinoid synthase variant contains a unique single amino acid substitution or multiple amino acid substitutions relative to the base natural consensus sequence constructs. This is done for n=160 CBDAS variants with select amino acid substitutions, (B) n=160 THCAS variants with select amino acid substitutions, (C) 15 THCAS variants with multiple substitutions to create a CBDAS variant and (D) n=63 CBDAS variants which are novel combinations of natural substitutions and (E) n=280 CBCAS variants with site saturation at select sites to create an improved CBCAS variant.

Each of these variant synthases demonstrating an altered synthase functional repertoire is provided herein as a variant cannabinoid synthase (e.g., a variant CBDAS, THCAS or CBCAS).

The variant sequences are described and set forth herein as SEQ ID NO: 1 to SEQ ID NO: 678. Each cannabinoid synthase variant contains a unique amino acid or multiple amino acid substitutions relative to the base native constructs (SEQ ID NO:1046 to SEQ ID NO: 1048).

B) Expression and purification of proteins from the synthesized cannabinoid synthase variants libraries.

DNA plasmids containing each of the cannabinoid synthase variants are individually transformed into S. cerevisiae yeast stain YPH857 by using chemically competent YPH857 yeast cells created by lithium acetate transformation protocol in the Yeast Protocols Handbook provided by Clonetech Laboratories (www.clontech.com). This produces individual S cerevisiae yeast stains, each containing a yeast expression plasmid encoding a single cannabinoid synthase variant.

To induce protein expression, individual yeast strains encoding each of the "cannabinoid synthase variants" driven by a yeast constitutive promoter, are individually inoculated into 100 milliliters of select minimal yeast media with in a 250 milliliter culture flask and grown at 30 degrees Celsius until saturation (~3-4 days) with vigorous shaking. Upon reaching saturation, each culture is diluted into 1000 milliliters of YPDA yeast media in a 2000 milliliter culture flask and grown at 30 degrees Celsius for 24 hours with vigorous shaking. After 24 hours each yeast culture is harvested by spinning down at 4,000G and the supernatant was removed and the yeast pellets were saved for target protein extraction.

Each individual yeast cell pellets is resuspended in 25 milliliters of a solution containing 50 millimolar Tris-HCL, 500 millimolar sodium chloride, 5 millimolar imidazole, and 10% glycerol pH 7.8 ("lysis buffer"), resulting in a "cell slurry." To each individual "cell slurry", 30 microliters of 25 units per microliter Benzonase (Millipore, Benzonase, catalog number 70664-1), as well as 300 microliters of phosphatase and protease inhibitor (Thermo-Fisher, Halt Protease and Phosphatase Inhibitor Cocktail, EDTA-free, catalog number 78441) and 10 mg of Zymolyase®-20T (Sunrise Science Products, catalog number N0766391) are added. Each "cell slurry" is incubated with gentle agitation for 30 minutes at 370 C. After incubation each individual "cell slurry" is then subjected to 30 second pulses of sonication, 4 times each, for a total of 120 seconds, using the Fisher Scientific Sonic Dismembrator Model 500 under 30% amplitude conditions. In between each 30 second pulse of sonication, the "cell slurry" is placed on ice for 30 seconds. After sonication, each "cell slurry" is centrifuged for 45 minutes at 14,000 times gravity to separate the soluble and insoluble fractions.

Protein purification columns (Bio-Rad, Econo-Pac Chromotography Columns, catalog number 7321010) are prepared by adding 1.5 milliliters TALON® Superflow Metal Affinity Resin slurry (Takara, TALON® Superflow Metal Affinity Resin, catalog number 635506). 5 milliliters deionized water is added to resin slurry, to agitate and rinse the resin. The columns are then uncapped and the resulting flow-through was discarded. Then, 5 milliliters deionized water are added a second time, and the resulting flow-through is discarded. Then, 10 milliliters "lysis buffer" is added to the resin, completely disturbing the resin bed, and the flow-through will be discarded.

The protein purification columns are capped, and the supernatant from the "cell slurry" is added to the resin bed without disturbing the resin bed. The columns are uncapped, allowing the supernatant to pass over the resin bed. The resin is then washed 2 times with 10 milliliters of a solution containing 50 millimolar Tris-HCl, 500 millimolar sodium chloride, and 20 millimolar imidazole pH 7.8 ("wash buffer"). The flow-through from the wash steps is discarded. The protein is then eluted off the column with 7.5 milliliters of a solution containing 50 millimolar Tris-HCl, 200 millimolar sodium chloride, and 250 millimolar imidazole pH 7.8. The eluted protein is collected and dialyzed overnight in 4 liters of a solution containing 100 millimolar sodium citrate pH 5.5 in 3.5-5.0 kilodalton dialysis tubing (Spectrum Labs, Spectra/Por dialysis tubing, catalog number 133198). After overnight dialysis, protein is concentrated to approximately 100 uL using centrifugal protein filters (Millipore Amicon Ultra-15 Ultracel 10K, catalog number UFC901024). UV absorbance at 280 nm is used for measurement of concentrated proteins to estimate cannabinoid synthase variant yield per liter of yeast culture.

C) Screening of the cannabinoid synthase protein variants for protein activity and phenotypes.

The library of cannabinoid synthase variants is screened for protein expression by western blot with an anti-HIS antibody (Cell Signaling Technologies, anti-his monoclonal antibody, catalog number 23655) according to the protocol provided by Cell Signaling Technologies for the antibody. Any variants that demonstrate detectable levels of protein expression as determined by western blot are used in an oxidocyclization assay with CBGA.

Proteins that exhibited detectable expression by western blot are assayed for oxidocyclization activity using CBGA as a substrate. Each reaction is performed in a volume of 20-100 microliters and contained 100 millimolar Sodium Citrate pH 5.5, 0.2 millimolar CBGA and activecannabinoid synthase variant protein. These reactions are incubated for 16 hours at 37° C.

To assess oxidocyclization activity by HPLC the oxidocyclization products are extracted from the assay reaction with the following protocol: 2:1 ratio v/v of ethyl acetate: reaction mix is added to each reaction and vortexed thoroughly. After vortexing, each reaction is centrifuged for 1 minute at 14,000G. The top layer ("organic layer") is collected. This is repeated twice. The collected organic layer is evaporated, and the resulting residue is resuspended in 40 microliters of 100% methanol. After resuspending in methanol, 40 microliters of 100% HPLC grade water is added to bring the final solution to 50% methanol. These are referred to as the "variant reactions with CBGA."

The final 50% methanol solutions are run on a Thermo Fisher UltiMate 3000 UHPLC with an Acclaim RSLC 120 angstrom C18 column with a 4 millimeter Phenomonex Securityguard guard column (54 millimeter total column length). Product is detected by ultraviolet light absorption at 270 nm.

D) Assigning individual cannabinoid synthase variants to specific protein activity and phenotypes.

Example 7

CBDAS stacking of mutations: Based on the data obtained from the CBDA site-saturation amino acid substitution library (Table 8), 7 mutations were chosen for a subsequent analysis of double and triple mutation combinations based on their ability to result in an increased yield of cannabinoids relative to a wild type CBDAS or an increased proportion of CBDA:THCA relative to a wild type CBDAS. These mutations included H69K, H69Q, H69V, H69G, A414V, A414I, and I445M.

Figure 15:
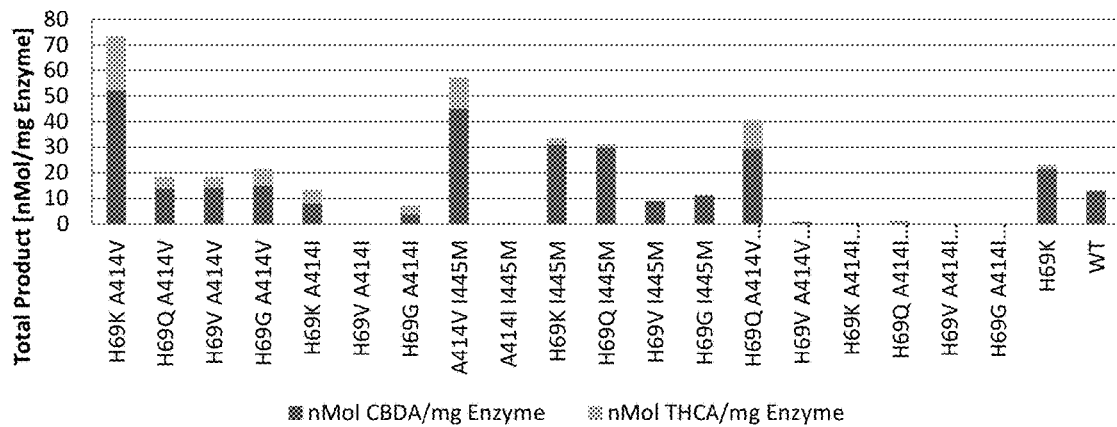
FIG. 15 illustrates total products in nMol/mg enzyme generated from CBDAS stacking variants with CBGA as a substrate.
Figure 16:
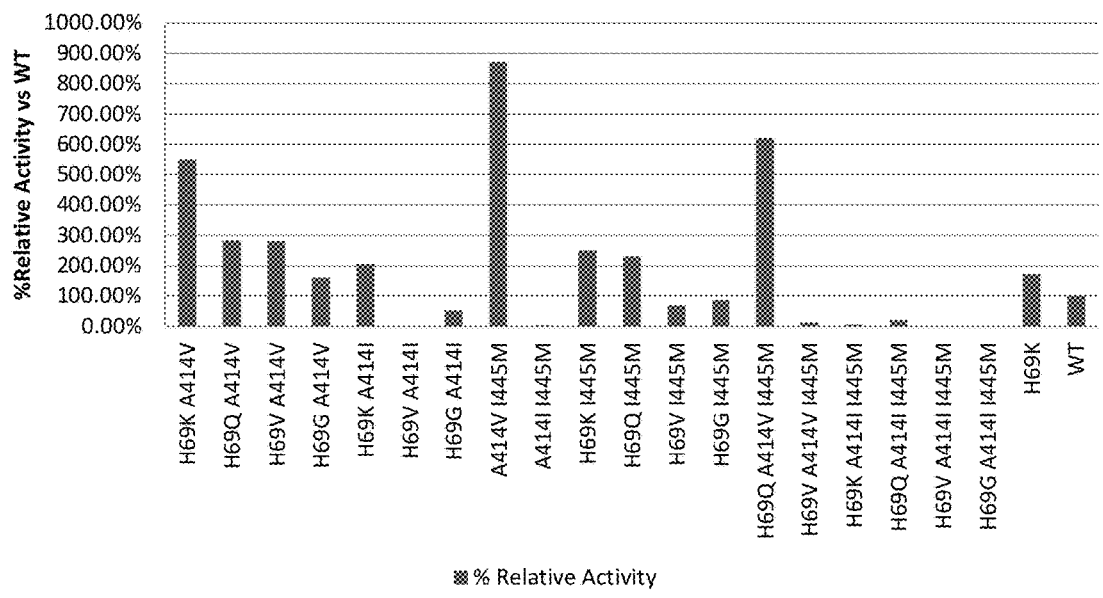
FIG. 16 illustrates percent relative activity vs the wild type enzyme of CBDAS stacking variants with CBGA as a substrate.
Figure 17:
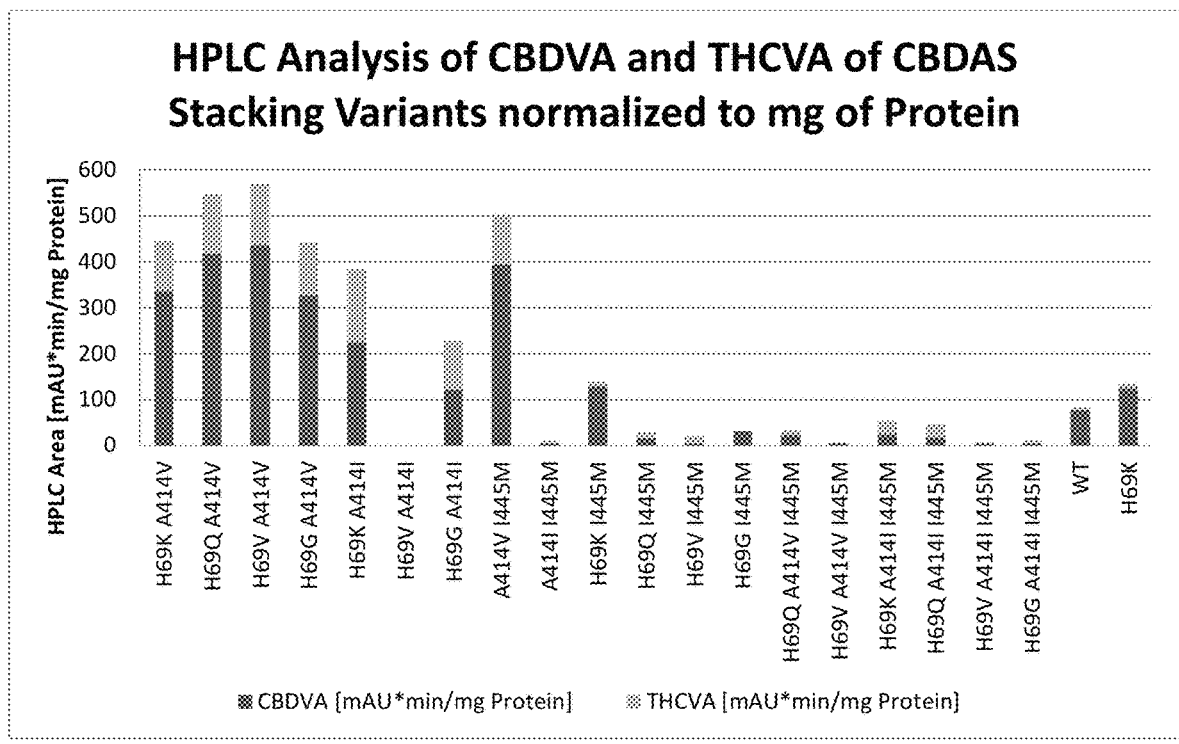
FIG. 17 mAU*min normalized to mg of protein CBDAS Stacking Variants with CBGVA as a substrate.

Double mutations examined included: H69K/A414V, H69Q/A414V, H69V/A414V, H69G/A414V, H69K/A414I, H69Q/A414I, H69V/A414I, H69G/A414I, A414V/I445M, A414I/I445M, H69K/I445M, H69Q/I445M, H69V/I445M, and H69G/I445M. Triple mutations examined included: H69K/A414V/I445M, H69Q/A414V/I445M, H69V/A414V/I445M, H69G/A414V/I445M, H69K/A414I/I445M, H69Q/A414I/I445M, H69V/A414I/I445M, and H69G/A414I/I445M. Results are displayed in Table 11, Table 12, and FIGS. 15-17.

The above description of the disclosed embodiments is provided to enable any person skilled in the art to make or use the described compositions and perform the described methods. Various modifications to these embodiments will be readily apparent to those skilled in the art, and the generic principles described herein can be applied to other embodiments without departing from the spirit or scope of the disclosure. Thus, it is to be understood that the description and drawings presented herein represent a presently preferred embodiment and are therefore representative of the subject matter which is broadly contemplated by the present disclosure. It is further understood that the scope of the present disclosure fully encompasses other embodiments that may become obvious to those skilled in the art and that the scope of the present disclosure is accordingly not limited.

LENGTHY TABLES

The patent contains a lengthy table section. A copy of the table is available in electronic form from the USPTO web site (https://seqdata.uspto.gov/?pageRequest=docDetail&DocID=US11920166B2). An electronic copy of the table will also be available from the USPTO upon request and payment of the fee set forth in 37 CFR 1.19(b)(3).

SEQUENCE LISTING (1083 sequences)

SEQ ID NO: 1 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgctaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 2 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccatttgtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 3 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgataatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 4 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 5 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccatttttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 6 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattggtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 7 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcataatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 8 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattattaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 9 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 10 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattttgaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 11 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattatgaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 12 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaataatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 13 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattccaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 14 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 15 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattagaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 16 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccatttctaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 17 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattactaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 18 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 19 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccatttggaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 20 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccatttataatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 21 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtagctgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 22 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 23 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtagatgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 24 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtagaagctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 25 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatttgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 26 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaggtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 27 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtacatgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 28 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaattgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 29 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaaaagctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 30 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtattggctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 31 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaatggctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 32 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaaatgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 33 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaccagctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 34 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtacaagctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 35 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaagagctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 36 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatctgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 37 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtaactgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 38 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtagttgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 39 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgggctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 40 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatatgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 41 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgctttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 42 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtattgtttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 43 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgatttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 44 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgaattatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 45 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtattttttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 46 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatggtttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 47 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatcatttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 48 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 49 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtataaattatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 50 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatttgttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 51 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatatgttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 52 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtataatttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 53 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatccattatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 54 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatcaattatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 55 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatagattatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 56 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtattctttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 57 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatactttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 58 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 59 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtattggttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 60 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtattatttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 61 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacgcttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 62 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtactgttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 63 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacgattgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 64 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacgaatgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 65 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacttttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 66 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacggttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 67 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtaccattgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 68 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 69 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacaaatgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 70 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacttgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 71 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 72 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacaattgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 73 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacccatgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 74 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtaccaatgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 75 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacagatgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 76 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtactcttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 77 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacacttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 78 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacgtttgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 79 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtactggtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 80 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtactattgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 81 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacagctttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 82 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacatgtttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 83 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacagatttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 84 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacagaattttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 85 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacatttttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 86 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaggtttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 87 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacacatttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 88 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaattttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 89 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaaaattttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 90 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacattgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 91 - DNA, 1638 bp, synthetic construct; identical to SEQ ID NO: 22
  source 1..1638: mol_type = other DNA; note = Description of Artificial Sequence: Synthetic polynucleotide

SEQ ID NO: 92 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaaatttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 93 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaccattttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 94 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacacaattttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 95 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaagattttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 96 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacatctttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 97 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaactttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 98 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacagttttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 99 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacatggttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 100 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacatatttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 101 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactgctaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 102 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattacttgtaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 103 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactgataacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 104 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactgaaaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 105 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattacttttaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 106 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactggtaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 107 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactcataacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 108 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactattaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 109 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaaaaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 110 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactttgaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 111 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactatgaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 112 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaataacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 113 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactccaaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 114 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactcaaaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 115 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactagaaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 116 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattacttctaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 117 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactactaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 118 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactgttaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 119 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattacttggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 120 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattacttataacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 121 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtgctaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 122 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggttgtaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 123 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtgataatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 124 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtgaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 125 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggttttaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 126 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtggtaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 127 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcataatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 128 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtattaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 129 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtaaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 130 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtttgaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 131 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtatgaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 132 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtaataatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 133 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtccaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 134 - DNA, 1638 bp, synthetic construct; identical to SEQ ID NO: 22
  source 1..1638: mol_type = other DNA; note = Description of Artificial Sequence: Synthetic polynucleotide

SEQ ID NO: 135 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtagaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 136 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggttctaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 137 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtactaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 138 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtgttaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 139 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggttggaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 140 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggttataatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 141 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaagctggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 142 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaatgtggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 143 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaagatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 144 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaagaaggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 145 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaatttggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 146 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaggtggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 147 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaacatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 148 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaattggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 149 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaaaggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 150 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaattgggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 151 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaatgggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 152 - DNA, 1638 bp, synthetic construct; identical to SEQ ID NO: 22
  source 1..1638: mol_type = other DNA; note = Description of Artificial Sequence: Synthetic polynucleotide

SEQ ID NO: 153 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaccaggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 154 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaacaaggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 155 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaagaggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 156 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaatctggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 157 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaactggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 158 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaagttggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 159 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaatggggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 160 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaatatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 161 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatagctaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 162 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatatgtaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 163 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatagataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 164 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatagaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 165 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatatttaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 166 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataggtaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 167 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 168 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataattaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 169 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataaaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 170 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatattgaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 171 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataatgaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 172 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataaataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 173 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataccaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 174 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 175 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataagaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 176 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatatctaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 177 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaataactaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 178 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatagttaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 179 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatatggaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 180 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatatataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 181 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtagctgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 182 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 183 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtagatgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 184 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtagaagtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 185 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatttgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 186 - DNA, 1635 bp, synthetic construct; identical to SEQ ID NO: 174
  source 1..1635: mol_type = other DNA; note = Description of Artificial Sequence: Synthetic polynucleotide

SEQ ID NO: 187 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtacatgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 188 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaattgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 189 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaaaagtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 190 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtattggtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 191 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaatggtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 192 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaaatgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 193 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaccagtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 194 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtacaagtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 195 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaagagtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 196 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatctgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 197 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaactgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 198 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtagttgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 199 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgggtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 200 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatatgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 201 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 202 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtactgtttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 203 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgatttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 204 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgaattgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 205 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtactttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 206 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacggtttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 207 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtaccatttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 208 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacattttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 209 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacaaattgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 210 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacttgttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 211 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacatgttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 212 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacaatttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 213 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacccattgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 214 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtaccaattgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 215 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacagattgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 216 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtactctttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 217 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacactttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 218 - DNA, 1635 bp, synthetic construct; identical to SEQ ID NO: 174
  source 1..1635: mol_type = other DNA; note = Description of Artificial Sequence: Synthetic polynucleotide

SEQ ID NO: 219 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtactggttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 220 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtactatttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 221 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacgctgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 222 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtactgtgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 223 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacgatgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 224 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacgaagcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 225 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtactttgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 226 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacggtgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 227 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtaccatgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 228 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 229 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacaaagcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 230 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacttggcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 231 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacatggcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 232 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacaatgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 233 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacccagcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 234 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtaccaagcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 235 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacagagcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 236 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtactctgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 237 - DNA, 1635 bp, synthetic construct; identical to SEQ ID NO: 174
  source 1..1635: mol_type = other DNA; note = Description of Artificial Sequence: Synthetic polynucleotide

SEQ ID NO: 238 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacgttgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 239 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtactgggcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 240 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtactatgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 241 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactgctttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 242 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaacttgtttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 243 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactgatttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 244 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactgaattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 245 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaacttttttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 246 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactggtttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 247 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactcatttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 248 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactattttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 249 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactaaattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 250 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactttgttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 251 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatgttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 252 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactaatttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 253 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactccattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 254 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactcaattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 255 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactagattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 256 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaacttctttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 257 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactactttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 258 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactgttttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 259 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaacttggttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 260 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaacttatttctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 261 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactgctaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 262 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattacttgtaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 263 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactgataacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 264 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactgaaaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 265 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattacttttaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 266 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactggtaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 267 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactcataacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 268 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactattaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 269 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaaaaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 270 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactttgaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 271 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactatgaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 272 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaataacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 273 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactccaaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 274 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactcaaaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 275 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactagaaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 276 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattacttctaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 277 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactactaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 278 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactgttaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 279 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattacttggaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 280 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattacttataacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 281 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggagctaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 282 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggatgtaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 283 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggagataagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 284 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggagaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 285 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggatttaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 286 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaggtaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 287 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggacataagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 288 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaattaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 289 - DNA, 1635 bp, synthetic construct; identical to SEQ ID NO: 174
  source 1..1635: mol_type = other DNA; note = Description of Artificial Sequence: Synthetic polynucleotide

SEQ ID NO: 290 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggattgaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 291 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaatgaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 292 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaataagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 293 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaccaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 294 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggacaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 295 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaagaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 296 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggatctaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 297 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaactaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 298 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggagttaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 299 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggatggaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 300 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggatataagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 301 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaagctacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 302 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaatgtacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 303 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaagatacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 304 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaagaaacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 305 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaatttacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 306 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaggtacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 307 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaacatacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 308 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaattacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 309 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaaaacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 310 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaattgacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 311 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaatgacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 312 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaatacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 313 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaccaacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 314 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaacaaacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 315 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaagaacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 316 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaatctacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 317 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaactacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 318 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaagttacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 319 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaatggacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 320 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaatatacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 321 - DNA, 1635 bp, synthetic construct; identical to SEQ ID NO: 167
  source 1..1635: mol_type = other DNA; note = Description of Artificial Sequence: Synthetic polynucleotide

SEQ ID NO: 322 - DNA, 1635 bp, synthetic construct; identical to SEQ ID NO: 182
  source 1..1635: mol_type = other DNA; note = Description of Artificial Sequence: Synthetic polynucleotide

SEQ ID NO: 323 - DNA, 1635 bp, synthetic construct; identical to SEQ ID NO: 201
  source 1..1635: mol_type = other DNA; note = Description of Artificial Sequence: Synthetic polynucleotide

SEQ ID NO: 324 - DNA, 1635 bp, synthetic construct; identical to SEQ ID NO: 228
  source 1..1635: mol_type = other DNA; note = Description of Artificial Sequence: Synthetic polynucleotide

SEQ ID NO: 325 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 326 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 327 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 328 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 329 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 330 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 331 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacactgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 332 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgttttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 333 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtaggtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 334 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacaaaacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 335 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaatccaagagagaacttcttaaaatgtttctcaaagcatattccaaataatgttgcaaaccctaagttagtctatacacaacatgaccaattgtatatgtcaatcttgaactcaacaatacataacttgagatttatctcagatactacacctaaaccattagtcatagtaactccttctaataattctcacatacaagctacaattttatgttcaaaaaaagtcggtttgcagattagaacaaggtcaggaggtcacgacgctgagggtatgtcttatatctcacaagtcccattcgttgtcgtcgatttgagaaatatgcactcaataaaaatagacgttcattcacagacagcttgggttgaagccggagccacattaggtgaggtctattactggataaatgagaaaaatgaaaacttgtcttttcctggaggatactgtcctaccgtatgtgtaggtggtcatttttctggtggtggatatggagccttaatgagaaactatggtttggcagccgacaacatcattgacgcacacttggtcaatgttgatggtaaagtcttagatagaaaatcaatgggtgaagatttattttgggcaataagaggtggaggaggtgagaactttggtattatcgctgcttggaagatcaagttggttgcagtaccttctaagtcaactatattctcagttaaaaagaacatggaaatacatggtttggttaaattattcaataagtggcaaaacatcgcatacaaatacgacaaggacttagtcttaatgactcattttattactaagaacattacagataatcacggtaaaaacaaaacaacagtacacggatatttttcttctatttttcatggaggtgttgattcattagtcgatttgatgaataaatcatttcctgagttaggtattaaaaagacagattgtaaagagttctcttggatagacactaccatattttattctggtgttgtcaacttcaataccgccaacttcaaaaaggagattttgttggatagatcagccggaaaaaagacagccttctctatcaagttggactacgtcaagaaaccaattcctgagactgctatggttaagattttagagaaattgtatgaagaggacgtaggagcaggtatgtacgctttgtatccttacggtggaattatggaagaaatctctgaatctgccattcctttccctcatagagcaggtatcatgtatgaattgtggtacattgcctcttgggaaaaacaagaagataatgagaaacacataaactgggtcagatcagtttacaactttaccacaccttatgtatctcaaaaccctagattggcatacttgaactacagagatttggatttgggtaaaaccaaccacgcatcacctaacaactatactcaggcaagaatatggggagaaaaatacttcggtaaaaacttcaatagattagtcaaagtaaagactaaagttgatcctaacaatttttttagaaatgaacaatctatcccacctttgccacctcaccatcaccaccaccactaa

SEQ ID NO: 336 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 337 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 338 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 339 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 340 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 341 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 342 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 343 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 344 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 345 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 346 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 347 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 348 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 349 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 350 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 351 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 352 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 353 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 354 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 355 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 356 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 357 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 358 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 359 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 360 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 361 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 362 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 363 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 364 - DNA, 1638 bp, synthetic construct; identical to SEQ ID NO: 344
  source 1..1638: mol_type = other DNA; note = Description of Artificial Sequence: Synthetic polynucleotide

SEQ ID NO: 365 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 366 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 367 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 368 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 369 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 370 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 371 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 372 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 373 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 374 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 375 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 376 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 377 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 378 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 379 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 380 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 381 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 382 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 383 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 384 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 385 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 386 - DNA, 1638 bp, synthetic construct; identical to SEQ ID NO: 365
  source 1..1638: mol_type = other DNA; note = Description of Artificial Sequence: Synthetic polynucleotide

SEQ ID NO: 387 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 388 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 389 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 390 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 391 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 392 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 393 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 394 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 395 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 396 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 397 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 398 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagattttcttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttagatctcagacagcctgggtagaagccggtgctactttaggagaagtttactattgggttaatgagaagaacgagtctttgtcattagcagcaggttactgcccaaccgtatgtgctggtggtcattttggtggtggtggatatggacctttgatgaggtcttatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctcaaaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacaccatcaccaccaccaccaccactaa

SEQ ID NO: 399 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctgctgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 400 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaacccttgtgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 401 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctgatgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 402 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctgaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 403 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaacccttttgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 404 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctggtgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 405 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcatgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 406 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctattgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 407 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctaaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 408 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctttggagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 409 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctatggagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 410 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctaatgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 411 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctccagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 412 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 413 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctagagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 414 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaacccttctgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 415 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctactgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 416 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctgttgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 417 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaacccttgggagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 418 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaacccttatgagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 419 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgcttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 420 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctcttgttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 421 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgattacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 422 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgaatacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 423 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctttttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 424 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctggttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 425 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctcattacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 426 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctatttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 427 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctaaatacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 428 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctttgtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 429 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctatgtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 430 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctaattacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 431 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctccatacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 432 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctcaatacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 433 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctagatacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 434 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctcttcttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 435 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctacttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 436 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgtttacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 437 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctcttggtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 438 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctcttattacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 439 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatgctgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 440 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaattgtgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 441 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatgatgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 442 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatgaagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 443 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaattttgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 444 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatggtgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 445 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatcatgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 446 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatattgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 447 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaataaagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 448 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatttggctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 449 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatatggctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 450 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaataatgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 451 - DNA, 1635 bp, synthetic construct; identical to SEQ ID NO: 412
  source 1..1635: mol_type = other DNA; note = Description of Artificial Sequence: Synthetic polynucleotide

SEQ ID NO: 452 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatcaagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 453 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatagagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 454 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaattctgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 455 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatactgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 456 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatgttgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 457 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaattgggctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 458 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaattatgctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 459 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcgcttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 460 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattctgttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 461 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcgattctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 462 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcgaatctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 463 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcttttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 464 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcggttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 465 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattccattctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 466 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcatttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 467 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcaaatctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 468 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcttgtctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 469 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcatgtctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 470 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcaattctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 471 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcccatctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 472 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattccaatctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 473 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcagatctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 474 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattctcttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 475 - DNA, 1635 bp, synthetic construct; identical to SEQ ID NO: 412
  source 1..1635: mol_type = other DNA; note = Description of Artificial Sequence: Synthetic polynucleotide

SEQ ID NO: 476 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcgtttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 477 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattctggtctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 478 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattctattctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 479 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgcttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 480 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaactgttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 481 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgattcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 482 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgaatcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 483 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacttttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 484 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacggttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 485 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaaccattcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 486 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacatttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 487 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacaaatcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 488 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacttgtcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 489 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacatgtcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 490 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacaattcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 491 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacccatcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 492 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaaccaatcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 493 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacagatcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 494 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaactcttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 495 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacacttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 496 - DNA, 1635 bp, synthetic construct; identical to SEQ ID NO: 412
  source 1..1635: mol_type = other DNA; note = Description of Artificial Sequence: Synthetic polynucleotide

SEQ ID NO: 497 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaactggtcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 498 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaactattcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 499 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgaggctaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 500 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagtgtaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 501 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgaggataacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 502 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgaggaaaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 503 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagtttaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 504 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagggtaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 505 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagcataacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 506 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagattaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 507 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagaaaaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 508 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagttgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 509 - DNA, 1635 bp, synthetic construct; identical to SEQ ID NO: 412
  source 1..1635: mol_type = other DNA; note = Description of Artificial Sequence: Synthetic polynucleotide

SEQ ID NO: 510 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagaataacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 511 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagccaaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 512 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagcaaaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 513 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagagaaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 514 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagtctaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 515 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagactaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 516 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgaggttaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 517 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagtggaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 518 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagtataacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 519 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggctactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 520 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagtgtactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 521 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggatactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 522 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggaaactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 523 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagtttactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 524 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagggtactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 525 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagcatactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 526 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagattactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 527 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagaaaactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 528 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagttgactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 529 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagatgactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 530 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagaatactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 531 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagccaactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 532 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagcaaactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 533 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagagaactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 534 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagtctactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 535 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagactactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 536 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggttactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 537 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagtggactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 538 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaagtatactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 539 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctggctttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 540 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgtgtttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 541 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctggatttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 542 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctggaattgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 543 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgtttttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 544 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgggtttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 545 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgcatttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 546 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgattttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 547 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgaaattgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 548 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgttgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 549 - DNA, 1635 bp, synthetic construct; identical to SEQ ID NO: 412
  source 1..1635: mol_type = other DNA; note = Description of Artificial Sequence: Synthetic polynucleotide

SEQ ID NO: 550 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgaatttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 551 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgccattgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 552 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgcaattgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 553 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgagattgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 554 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgtctttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 555 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgactttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 556 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctggttttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 557 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgtggttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 558 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgtatttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 559 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttggctacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 560 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgtgtacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 561 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttggatacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 562 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttggaaacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 563 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgtttacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 564 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgggtacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 565 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgcatacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 566 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgattacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 567 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgaaaacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 568 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgttgacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 569 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgatgacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 570 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgaatacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 571 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgccaacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 572 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgcaaacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 573 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgagaacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 574 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgtctacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 575 - DNA, 1635 bp, synthetic construct; identical to SEQ ID NO: 412
  source 1..1635: mol_type = other DNA; note = Description of Artificial Sequence: Synthetic polynucleotide

SEQ ID NO: 576 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttggttacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 577 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgtggacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 578 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgtatacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 579 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcgctaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 580 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttctgtaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 581 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcgataccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 582 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcgaaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 583 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttctttaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 584 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcggtaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 585 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttccataccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 586 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcattaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 587 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcaaaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 588 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcttgaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 589 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcatgaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 590 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcaataccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 591 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcccaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 592 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttccaaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 593 - DNA, 1635 bp, synthetic construct; identical to SEQ ID NO: 412
  source 1..1635: mol_type = other DNA; note = Description of Artificial Sequence: Synthetic polynucleotide

SEQ ID NO: 594 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttctctaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 595 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcactaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 596 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcgttaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 597 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttctggaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 598 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttctataccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 599 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcgctggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 600 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttctgtggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 601 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcgatggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 602 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcgaaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 603 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttctttggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 604 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcggtggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 605 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttccatggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 606 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcattggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 607 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcaaaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 608 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttgggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 609 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcatgggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 610 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcaatggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 611 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcccaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 612 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttccaaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 613 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcagaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 614 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttctctggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 615 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcactggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 616 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcgttggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 617 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttctggggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 618 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttctatggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 619 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaaggctattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 620 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagtgtattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 621 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaaggatattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 622 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaaggaaattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 623 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagtttattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 624 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagggtattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 625 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagcatattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 626 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagattattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 627 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagaaaattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 628 - DNA, 1635 bp, synthetic construct; identical to SEQ ID NO: 412
  source 1..1635: mol_type = other DNA; note = Description of Artificial Sequence: Synthetic polynucleotide

SEQ ID NO: 629 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagatgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 630 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagaatattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 631 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagccaattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 632 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagcaaattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 633 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagagaattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 634 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagtctattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 635 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagactattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 636 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaaggttattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 637 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagtggattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 638 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagtatattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 639 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctgcttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 640 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgcttgttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 641 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctgattgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 642 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctgaatgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 643 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctttttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 644 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctggttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 645 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctcattgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 646 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctatttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 647 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctaaatgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 648 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctttgtgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 649 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctatgtgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 650 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctaattgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 651 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctccatgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 652 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctcaatgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 653 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctagatgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 654 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgcttcttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 655 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 656 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctgtttgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 657 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgcttggtgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 658 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgcttattgggaaaagcaagaagataacgaaaaacacatcaactgggtcagatccgtttacaattttactaccccatacgtgtctcagaatccaagattggcttacttgaactacagagatttggatttgggtaagactaacccagaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 659 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagcttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 660 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccatgttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 661 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagattctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 662 - DNA, 1635 bp, synthetic construct; identical to SEQ ID NO: 412
  source 1..1635: mol_type = other DNA; note = Description of Artificial Sequence: Synthetic polynucleotide

SEQ ID NO: 663 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccattttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 664 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaggttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 665 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccacattctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 666 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaatttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 667 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaaaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 668 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccattgtctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 669 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaatgtctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 670 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaaattctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 671 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaccatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 672 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccacaatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 673 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaagatctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 674 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccatcttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 675 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccaacttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 676 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccagtttctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 677 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccatggtctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 678 - DNA, 1635 bp, synthetic construct
  source 1..1635: mol_type = other DNA; note = Description of Artificial Sequence: Synthetic polynucleotide
atgttctccttgaaagctttgttgccattggctttgttgttggtttctgctaatcaagttgctgctaaggttaaccctcaagagaactttttgaagtgcttctctgagtacattccaaacaatccagctaacccaaagttcatctacactcaacatgatcagttgtacatgtccgttttgaactccaccattcagaacttgagattcacttctgataccactccaaagccattggttatagttactccatccaacgtttcccatattcaagcttctattctgtgctctaaaaaggtcggcttgcaaattagaactagatctggtggtcatgatgctgaaggtttgtcttacatttcccaagttccattcgctatcgttgacttgagaaatatgcataccgttaaggttgacatccattctcaaactgcttgggttgaagctggtgctactttgggtgaagtttattactggatcaacgagatgaacgagaacttctcatttccaggtggttattgtccaactgttggtgttggtggtcacttttctggtggtggttatggtgctttgatgagaaattatggtttggccgccgataacattattgatgctcatttggttaacgtcgacggtaaggttttggatagaaaatctatgggcgaagatttgttctgggctattagaggtggtggtggcgaaaattttggtattattgctgcttgcaagatcaagttggttgttgttccatctaaggccactatcttctccgttaagaaaaacatggaaatccacggtttggtcaagttgtttaacaagtggcaaaacattgcctacaagtacgataaggatctgatgttgactacccatttcagaaccagaaacatcactgataaccacggtaagaacaagactactgttcatggttacttcagctccattttcttaggtggtgttgattccttggtcgacttgatgaacaagtcttttccagaattgggcatcaaaaagaccgactgcaaagaattgtcttggattgataccaccatcttctactctggtgttgttaactacaacaccgccaacttcaagaaagaaatcttgttggatagatccgccggtaaaaagactgctttctctattaagttggactacgtcaagaagttgattccagaaactgccatggttaagatcttggaaaagttgtacgaagaagaggttggcgttggtatgtatgtcttgtatccatacggtggtattatggacgaaatttccgaatccgctattccatttccacatagagcaggtatcatgtacgaattgtggtatactgctacctgggaaaagcaagaagataacgaaaaacacatcaactgggtcagatccgtttacaattttactaccccatacgtgtctcagaatccaagattggcttacttgaactacagagatttggatttgggtaagactaacccatattctccaaacaactatacccaagctagaatttggggtgaaaagtacttcggcaagaactttaacagattggttaaggttaagaccaaggctgacccaaacaatttcttcagaaacgaacaatccattccaccattgccaccaagacatcatcaccatcatcat

SEQ ID NO: 679 - DNA, 43 bp, synthetic construct
  source 1..43: mol_type = other DNA; note = Description of Artificial Sequence: Synthetic primer
cagtcttaaactcaaccattgctaatttaagatttacttctga

SEQ ID NO: 680 - DNA, 43 bp, synthetic construct
  source 1..43: mol_type = other DNA; note = Description of Artificial Sequence: Synthetic primer
cagtcttaaactcaaccatttgtaatttaagatttacttctga

SEQ ID NO: 681 - DNA, 43 bp, synthetic construct
  source 1..43: mol_type = other DNA; note = Description of Artificial Sequence: Synthetic primer
cagtcttaaactcaaccattgataatttaagatttacttctga

SEQ ID NO: 682 - DNA, 43 bp, synthetic construct
  source 1..43: mol_type = other DNA; note = Description of Artificial Sequence: Synthetic primer
cagtcttaaactcaaccattgaaaatttaagatttacttctga

SEQ ID NO: 683 - DNA, 43 bp, synthetic construct
  source 1..43: mol_type = other DNA; note = Description of Artificial Sequence: Synthetic primer
cagtcttaaactcaaccatttttaatttaagatttacttctga

SEQ ID NO: 684 - DNA, 43 bp, synthetic construct
  source 1..43: mol_type = other DNA; note = Description of Artificial Sequence: Synthetic primer
cagtcttaaactcaaccattggtaatttaagatttacttctga

SEQ ID NO: 685 - DNA, 43 bp, synthetic construct
  source 1..43: mol_type = other DNA; note = Description of Artificial Sequence: Synthetic primer
cagtcttaaactcaaccattcataatttaagatttacttctga

SEQ ID NO: 686 - DNA, 43 bp, synthetic construct
  source 1..43: mol_type = other DNA; note = Description of Artificial Sequence: Synthetic primer
cagtcttaaactcaaccattattaatttaagatttacttctga

SEQ ID NO: 687 - DNA, 43 bp, synthetic construct
  source 1..43: mol_type = other DNA; note = Description of Artificial Sequence: Synthetic primer
cagtcttaaactcaaccattaaaaatttaagatttacttctga

SEQ ID NO: 688 - DNA, 43 bp, synthetic construct
  source 1..43: mol_type = other DNA; note = Description of Artificial Sequence: Synthetic primer
cagtcttaaactcaaccattttgaatttaagatttacttctga

SEQ ID NO: 689 - DNA, 43 bp, synthetic construct
  source 1..43: mol_type = other DNA; note = Description of Artificial Sequence: Synthetic primer
cagtcttaaactcaaccattatgaatttaagatttacttctga

SEQ ID NO: 690 - DNA, 43 bp, synthetic construct
  source 1..43: mol_type = other DNA; note = Description of Artificial Sequence: Synthetic primer
cagtcttaaactcaaccattaataatttaagatttacttctga

SEQ ID NO: 691 - DNA, 43 bp, synthetic construct
  source 1..43: mol_type = other DNA; note = Description of Artificial Sequence: Synthetic primer
cagtcttaaactcaaccattccaaatttaagatttacttctga

SEQ ID NO: 692 - DNA, 43 bp, synthetic construct
  source 1..43: mol_type = other DNA; note = Description of Artificial Sequence: Synthetic primer
cagtcttaaactcaaccattcaaaatttaagatttacttctga

SEQ ID NO: 693 - DNA, 43 bp, synthetic construct
  source 1..43: mol_type = other DNA; note = Description of Artificial Sequence: Synthetic primer
cagtcttaaactcaaccattagaaatttaagatttacttctga

SEQ ID NO: 694 - DNA, 43 bp, synthetic construct
  source 1..43: mol_type = other DNA; note = Description of Artificial Sequence: Synthetic primer
cagtcttaaactcaaccatttctaatttaagatttacttctga

SEQ ID NO: 695 - DNA, 43 bp, synthetic construct
  source 1..43: mol_type = other DNA; note = Description of Artificial Sequence: Synthetic primer
cagtcttaaactcaaccattactaatttaagatttacttctga

SEQ ID NO: 696 - DNA, 43 bp, synthetic construct
  source 1..43: mol_type = other DNA; note = Description of Artificial Sequence: Synthetic primer
cagtcttaaactcaaccattgttaatttaagatttacttctga

SEQ ID NO: 697 - DNA, 43 bp, synthetic construct
  source 1..43: mol_type = other DNA; note = Description of Artificial Sequence: Synthetic primer
cagtcttaaactcaaccatttggaatttaagatttacttctga

SEQ ID NO: 698 - DNA, 43 bp, synthetic construct
  source 1..43: mol_type = other DNA; note = Description of Artificial Sequence: Synthetic primer
cagtcttaaactcaaccatttataatttaagatttacttctga

SEQ ID NO: 699 - DNA, 43 bp, synthetic construct
  source 1..43: mol_type = other DNA; note = Description of Artificial Sequence: Synthetic primer
caggttactgcccaaccgtagctgctggtggtcattttggtgg

SEQ ID NO: 700 - DNA, 43 bp, synthetic construct
  source 1..43: mol_type = other DNA; note = Description of Artificial Sequence: Synthetic primer
caggttactgcccaaccgtatgtgctggtggtcattttggtgg

SEQ ID NO: 701 - DNA, 43 bp, synthetic construct
  source 1..43: mol_type = other DNA; note = Description of Artificial Sequence: Synthetic primer
caggttactgcccaaccgtagatgctggtggtcattttggtgg

SEQ ID NO: 702 - DNA, 43 bp, synthetic construct
  source 1..43: mol_type = other DNA; note = Description of Artificial Sequence: Synthetic primer
caggttactgcccaaccgtagaagctggtggtcattttggtgg

SEQ ID NO: 703 - DNA, 43 bp, synthetic construct
  source 1..43: mol_type = other DNA; note = Description of Artificial Sequence: Synthetic primer
caggttactgcccaaccgtatttgctggtggtcattttggtgg

SEQ ID NO: 704 - DNA, 43 bp, synthetic construct
  source 1..43: mol_type = other DNA; note = Description of Artificial Sequence: Synthetic primer
caggttactgcccaaccgtaggtgctggtggtcattttggtgg

SEQ ID NO: 705 - DNA, 43 bp, synthetic construct
  source 1..43: mol_type = other DNA; note = Description of Artificial Sequence: Synthetic primer
caggttactgcccaaccgtacatgctggtggtcattttggtgg

SEQ ID NO: 706 - DNA, 43 bp, synthetic construct
  source 1..43: mol_type = other DNA; note = Description of Artificial Sequence: Synthetic primer
caggttactgcccaaccgtaattgctggtggtcattttggtgg

SEQ ID NO: 707 - DNA, 43 bp, synthetic construct
  source 1..43: mol_type = other DNA; note = Description of Artificial Sequence: Synthetic primer
caggttactgcccaaccgtaaaagctggtggtcattttggtgg

SEQ ID NO: 708 - DNA, 43 bp, synthetic construct
  source 1..43: mol_type = other DNA; note = Description of Artificial Sequence: Synthetic primer
caggttactgcccaaccgtattggctggtggtcattttggtgg

SEQ ID NO: 709 - DNA, 43 bp, synthetic construct
  source 1..43: mol_type = other DNA; note = Description of Artificial Sequence: Synthetic primer
caggttactgcccaaccgtaatggctggtggtcattttggtgg

SEQ ID NO: 710 - DNA, 43 bp, synthetic construct
  source 1..43: mol_type = other DNA; note = Description of Artificial Sequence: Synthetic primer
caggttactgcccaaccgtaaatgctggtggtcattttggtgg

SEQ ID NO: 711 - DNA, 43 bp, synthetic construct
  source 1..43: mol_type = other DNA; note = Description of Artificial Sequence: Synthetic primer
caggttactgcccaaccgtaccagctggtggtcattttggtgg

SEQ ID NO: 712 - DNA, 43 bp, synthetic construct
  source 1..43: mol_type = other DNA; note = Description of Artificial Sequence: Synthetic primer
caggttactgcccaaccgtacaagctggtggtcattttggtgg

SEQ ID NO: 713 - DNA, 43 bp, synthetic construct
  source 1..43: mol_type = other DNA; note = Description of Artificial Sequence: Synthetic primer
caggttactgcccaaccgtaagagctggtggtcattttggtgg

SEQ ID NO: 714 - DNA, 43 bp, synthetic construct; identical to SEQ ID NO: 694
  source 1..43: mol_type = other DNA; note = Description of Artificial Sequence: Synthetic primer

SEQ ID NO: 715 - DNA, 43 bp, synthetic construct; identical to SEQ ID NO: 695
  source 1..43: mol_type = other DNA; note = Description of Artificial Sequence: Synthetic primer

SEQ ID NO: 716 - DNA, 43 bp, synthetic construct; identical to SEQ ID NO: 696
  source 1..43: mol_type = other DNA; note = Description of Artificial Sequence: Synthetic primer

SEQ ID NO: 717 - DNA, 43 bp, synthetic construct; identical to SEQ ID NO: 697
  source 1..43: mol_type = other DNA; note = Description of Artificial Sequence: Synthetic primer

SEQ ID NO: 718 - DNA, 43 bp, synthetic construct; identical to SEQ ID NO: 698
  source 1..43: mol_type = other DNA; note = Description of Artificial Sequence: Synthetic primer

SEQ ID NO: 719 - DNA, 43 bp, synthetic construct
  source 1..43: mol_type = other DNA; note = Description of Artificial Sequence: Synthetic primer
atataggtgcaggtatgtatgctttatacccttatggtggtat

SEQ ID NO: 720 - DNA, 43 bp, synthetic construct
  source 1..43: mol_type = other DNA; note = Description of Artificial Sequence: Synthetic primer
atataggtgcaggtatgtattgtttatacccttatggtggtat

SEQ ID NO: 721 - DNA, 43 bp, synthetic construct
  source 1..43: mol_type = other DNA; note = Description of Artificial Sequence: Synthetic primer
atataggtgcaggtatgtatgatttatacccttatggtggtat

SEQ ID NO: 722 - DNA, 43 bp, synthetic construct
  source 1..43: mol_type = other DNA; note = Description of Artificial Sequence: Synthetic primer
atataggtgcaggtatgtatgaattatacccttatggtggtat

SEQ ID NO: 723 - DNA, 43 bp, synthetic construct
  source 1..43: mol_type = other DNA; note = Description of Artificial Sequence: Synthetic primer
atataggtgcaggtatgtattttttatacccttatggtggtat

SEQ ID NO: 724 - DNA, 43 bp, synthetic construct
  source 1..43: mol_type = other DNA; note = Description of Artificial Sequence: Synthetic primer
atataggtgcaggtatgtatggtttatacccttatggtggtat

SEQ ID NO: 725 - DNA, 43 bp, synthetic construct
  source 1..43: mol_type = other DNA; note = Description of Artificial Sequence: Synthetic primer
atataggtgcaggtatgtatcatttatacccttatggtggtat

SEQ ID NO: 726 - DNA, 43 bp, synthetic construct
  source 1..43: mol_type = other DNA; note = Description of Artificial Sequence: Synthetic primer
atataggtgcaggtatgtatattttatacccttatggtggtat

SEQ ID NO: 727 - DNA, 43 bp, synthetic construct
  source 1..43: mol_type = other DNA; note = Description of Artificial Sequence: Synthetic primer
atataggtgcaggtatgtataaattatacccttatggtggtat

SEQ ID NO: 728 - DNA, 43 bp, synthetic construct
  source 1..43: mol_type = other DNA; note = Description of Artificial Sequence: Synthetic primer
atataggtgcaggtatgtatttgttatacccttatggtggtat

SEQ ID NO: 729 - DNA, 43 bp, synthetic construct
  source 1..43: mol_type = other DNA; note = Description of Artificial Sequence: Synthetic primer
atataggtgcaggtatgtatatgttatacccttatggtggtat

SEQ ID NO: 730 - DNA, 43 bp, synthetic construct
  source 1..43: mol_type = other DNA; note = Description of Artificial Sequence: Synthetic primer
atataggtgcaggtatgtataatttatacccttatggtggtat

SEQ ID NO: 731 - DNA, 43 bp, synthetic construct
  source 1..43: mol_type = other DNA; note = Description of Artificial Sequence: Synthetic primer
atataggtgcaggtatgtatccattatacccttatggtggtat

SEQ ID NO: 732 - DNA, 43 bp, synthetic construct
  source 1..43: mol_type = other DNA; note = Description of Artificial Sequence: Synthetic primer
atataggtgcaggtatgtatcaattatacccttatggtggtat

SEQ ID NO: 733 - DNA, 43 bp, synthetic construct
  source 1..43: mol_type = other DNA; note = Description of Artificial Sequence: Synthetic primer
atataggtgcaggtatgtatagattatacccttatggtggtat

SEQ ID NO: 734 - DNA, 43 bp, synthetic construct
  source 1..43: mol_type = other DNA; note = Description of Artificial Sequence: Synthetic primer
atataggtgcaggtatgtattctttatacccttatggtggtat

SEQ ID NO: 735 - DNA, 43 bp, synthetic construct
  source 1..43: mol_type = other DNA; note = Description of Artificial Sequence: Synthetic primer
atataggtgcaggtatgtatactttatacccttatggtggtat

SEQ ID NO: 736 - DNA, 43 bp, synthetic construct
  source 1..43: mol_type = other DNA; note = Description of Artificial Sequence: Synthetic primer
atataggtgcaggtatgtatgttttatacccttatggtggtat

SEQ ID NO: 737 - DNA, 43 bp, synthetic construct
  source 1..43: mol_type = other DNA; note = Description of Artificial Sequence: Synthetic primer
atataggtgcaggtatgtattggttatacccttatggtggtat

SEQ ID NO: 738 - DNA, 43 bp, synthetic construct
  source 1..43: mol_type = other DNA; note = Description of Artificial Sequence: Synthetic primer
atataggtgcaggtatgtattatttatacccttatggtggtat

SEQ ID NO: 739 - DNA, 49 bp, synthetic construct
  source 1..49: mol_type = other DNA; note = Description of Artificial Sequence: Synthetic primer
ggtatattatatgaattgtggtacgcttgttcttgggagaaacaagagg

SEQ ID NO: 740 - DNA, 49 bp, synthetic construct
  source 1..49: mol_type = other DNA; note = Description of Artificial Sequence: Synthetic primer
ggtatattatatgaattgtggtactgttgttcttgggagaaacaagagg

SEQ ID NO: 741 - DNA, 49 bp, synthetic construct
  source 1..49: mol_type = other DNA; note = Description of Artificial Sequence: Synthetic primer
ggtatattatatgaattgtggtacgattgttcttgggagaaacaagagg

SEQ ID NO: 742 - DNA, 49 bp, synthetic construct
  source 1..49: mol_type = other DNA; note = Description of Artificial Sequence: Synthetic primer
ggtatattatatgaattgtggtacgaatgttcttgggagaaacaagagg

SEQ ID NO: 743 - DNA, 49 bp, synthetic construct
  source 1..49: mol_type = other DNA; note = Description of Artificial Sequence: Synthetic primer
ggtatattatatgaattgtggtacttttgttcttgggagaaacaagagg

SEQ ID NO: 744 - DNA, 49 bp, synthetic construct
  source 1..49: mol_type = other DNA; note = Description of Artificial Sequence: Synthetic primer
ggtatattatatgaattgtggtacggttgttcttgggagaaacaagagg

SEQ ID NO: 745 - DNA, 49 bp, synthetic construct
  source 1..49: mol_type = other DNA; note = Description of Artificial Sequence: Synthetic primer
ggtatattatatgaattgtggtaccattgttcttgggagaaacaagagg

SEQ ID NO: 746 - DNA, 49 bp, synthetic construct
  source 1..49: mol_type = other DNA; note = Description of Artificial Sequence: Synthetic primer
ggtatattatatgaattgtggtacatttgttcttgggagaaacaagagg

SEQ ID NO: 747 - DNA, 49 bp, synthetic construct
  source 1..49: mol_type = other DNA; note = Description of Artificial Sequence: Synthetic primer
ggtatattatatgaattgtggtacaaatgttcttgggagaaacaagagg

SEQ ID NO: 748 - DNA, 49 bp, synthetic construct
  source 1..49: mol_type = other DNA; note = Description of Artificial Sequence: Synthetic primer
ggtatattatatgaattgtggtacttgtgttcttgggagaaacaagagg

SEQ ID NO: 749 - DNA, 49 bp, synthetic construct
  source 1..49: mol_type = other DNA; note = Description of Artificial Sequence: Synthetic primer
ggtatattatatgaattgtggtacatgtgttcttgggagaaacaagagg

SEQ ID NO: 750 - DNA, 49 bp, synthetic construct
  source 1..49: mol_type = other DNA; note = Description of Artificial Sequence: Synthetic primer
ggtatattatatgaattgtggtacaattgttcttgggagaaacaagagg

SEQ ID NO: 751 - DNA, 49 bp, synthetic construct
  source 1..49: mol_type = other DNA; note = Description of Artificial Sequence: Synthetic primer
ggtatattatatgaattgtggtacccatgttcttgggagaaacaagagg

SEQ ID NO: 752 - DNA, 49 bp, synthetic construct
  source 1..49: mol_type = other DNA; note = Description of Artificial Sequence: Synthetic primer
ggtatattatatgaattgtggtaccaatgttcttgggagaaacaagagg

SEQ ID NO: 753 - DNA, 49 bp, synthetic construct
  source 1..49: mol_type = other DNA; note = Description of Artificial Sequence: Synthetic primer
ggtatattatatgaattgtggtacagatgttcttgggagaaacaagagg

SEQ ID NO: 754 - DNA, 49 bp, synthetic construct
  source 1..49: mol_type = other DNA; note = Description of Artificial Sequence: Synthetic primer
ggtatattatatgaattgtggtactcttgttcttgggagaaacaagagg

SEQ ID NO: 755 - DNA, 49 bp, synthetic construct
  source 1..49: mol_type = other DNA; note = Description of Artificial Sequence: Synthetic primer
ggtatattatatgaattgtggtacacttgttcttgggagaaacaagagg

SEQ ID NO: 756 - DNA, 49 bp, synthetic construct
  source 1..49: mol_type = other DNA; note = Description of Artificial Sequence: Synthetic primer
ggtatattatatgaattgtggtacgtttgttcttgggagaaacaagagg

SEQ ID NO: 757 - DNA, 49 bp, synthetic construct
  source 1..49: mol_type = other DNA; note = Description of Artificial Sequence: Synthetic primer
ggtatattatatgaattgtggtactggtgttcttgggagaaacaagagg

SEQ ID NO: 758 - DNA, 49 bp, synthetic construct
  source 1..49: mol_type = other DNA; note = Description of Artificial Sequence: Synthetic primer
ggtatattatatgaattgtggtactattgttcttgggagaaacaagagg

SEQ ID NO: 759 - DNA, 45 bp, synthetic construct
  source 1..45: mol_type = other DNA; note = Description of Artificial Sequence: Synthetic primer
ttgctgttccaaaatcaacagctttttctgttaagaagataatgg

SEQ ID NO: 760 - DNA, 45 bp, synthetic construct
  source 1..45: mol_type = other DNA; note = Description of Artificial Sequence: Synthetic primer
ttgctgttccaaaatcaacatgtttttctgttaagaagataatgg

SEQ ID NO: 761 - DNA, 45 bp, synthetic construct
  source 1..45: mol_type = other DNA; note = Description of Artificial Sequence: Synthetic primer
ttgctgttccaaaatcaacagatttttctgttaagaagataatgg

SEQ ID NO: 762 - DNA, 45 bp, synthetic construct
  source 1..45: mol_type = other DNA; note = Description of Artificial Sequence: Synthetic primer
ttgctgttccaaaatcaacagaattttctgttaagaagataatgg

SEQ ID NO: 763 - DNA, 45 bp, synthetic construct
  source 1..45: mol_type = other DNA; note = Description of Artificial Sequence: Synthetic primer
ttgctgttccaaaatcaacatttttttctgttaagaagataatgg

SEQ ID NO: 764 - DNA, 45 bp, synthetic construct
  source 1..45: mol_type = other DNA; note = Description of Artificial Sequence: Synthetic primer
ttgctgttccaaaatcaacaggtttttctgttaagaagataatgg

SEQ ID NO: 765 - DNA, 45 bp, synthetic construct
  source 1..45: mol_type = other DNA; note = Description of Artificial Sequence: Synthetic primer
ttgctgttccaaaatcaacacatttttctgttaagaagataatgg

SEQ ID NO: 766 - DNA, 45 bp, synthetic construct
  source 1..45: mol_type = other DNA; note = Description of Artificial Sequence: Synthetic primer
ttgctgttccaaaatcaacaattttttctgttaagaagataatgg

SEQ ID NO: 767 - DNA, 45 bp, synthetic construct
  source 1..45: mol_type = other DNA; note = Description of Artificial Sequence: Synthetic primer
ttgctgttccaaaatcaacaaaattttctgttaagaagataatgg

SEQ ID NO: 768 - DNA, 45 bp, synthetic construct
  source 1..45: mol_type = other DNA; note = Description of Artificial Sequence: Synthetic primer
ttgctgttccaaaatcaacattgttttctgttaagaagataatgg

SEQ ID NO: 769 - DNA, 45 bp, synthetic construct
  source 1..45: mol_type = other DNA; note = Description of Artificial Sequence: Synthetic primer
ttgctgttccaaaatcaacaatgttttctgttaagaagataatgg

SEQ ID NO: 770 - DNA, 45 bp, synthetic construct
  source 1..45: mol_type = other DNA; note = Description of Artificial Sequence: Synthetic primer
ttgctgttccaaaatcaacaaatttttctgttaagaagataatgg

SEQ ID NO: 771 - DNA, 45 bp, synthetic construct
  source 1..45: mol_type = other DNA; note = Description of Artificial Sequence: Synthetic primer
ttgctgttccaaaatcaacaccattttctgttaagaagataatgg

SEQ ID NO: 772 - DNA, 45 bp, synthetic construct
  source 1..45: mol_type = other DNA; note = Description of Artificial Sequence: Synthetic primer
ttgctgttccaaaatcaacacaattttctgttaagaagataatgg

SEQ ID NO: 773 - DNA, 45 bp, synthetic construct
  source 1..45: mol_type = other DNA; note = Description of Artificial Sequence: Synthetic primer
ttgctgttccaaaatcaacaagattttctgttaagaagataatgg

SEQ ID NO: 774 - DNA, 45 bp, synthetic construct
  source 1..45: mol_type = other DNA; note = Description of Artificial Sequence: Synthetic primer
ttgctgttccaaaatcaacatctttttctgttaagaagataatgg

SEQ ID NO: 775 - DNA, 45 bp, synthetic construct
  source 1..45: mol_type = other DNA; note = Description of Artificial Sequence: Synthetic primer
ttgctgttccaaaatcaacaactttttctgttaagaagataatgg

SEQ ID NO: 776 - DNA, 45 bp, synthetic construct
  source 1..45: mol_type = other DNA; note = Description of Artificial Sequence: Synthetic primer
ttgctgttccaaaatcaacagttttttctgttaagaagataatgg

SEQ ID NO: 777 - DNA, 45 bp, synthetic construct
  source 1..45: mol_type = other DNA; note = Description of Artificial Sequence: Synthetic primer
ttgctgttccaaaatcaacatggttttctgttaagaagataatgg

SEQ ID NO: 778 - DNA, 45 bp, synthetic construct
  source 1..45: mol_type = other DNA; note = Description of Artificial Sequence: Synthetic primer
ttgctgttccaaaatcaacatatttttctgttaagaagataatgg

SEQ ID NO: 779 - DNA, 46 bp, synthetic construct
  source 1..46: mol_type = other DNA; note = Description of Artificial Sequence: Synthetic primer
gttgatgacacattttattactgctaacattacagataatcaaggt

SEQ ID NO: 780 - DNA, 46 bp, synthetic construct
  source 1..46: mol_type = other DNA; note = Description of Artificial Sequence: Synthetic primer
gttgatgacacattttattacttgtaacattacagataatcaaggt

SEQ ID NO: 781 - DNA, 46 bp, synthetic construct
  source 1..46: mol_type = other DNA; note = Description of Artificial Sequence: Synthetic primer
gttgatgacacattttattactgataacattacagataatcaaggt

SEQ ID NO: 782 - DNA, 46 bp, synthetic construct
  source 1..46: mol_type = other DNA; note = Description of Artificial Sequence: Synthetic primer
gttgatgacacattttattactgaaaacattacagataatcaaggt

SEQ ID NO: 783 - DNA, 46 bp, synthetic construct
  source 1..46: mol_type = other DNA; note = Description of Artificial Sequence: Synthetic primer
gttgatgacacattttattacttttaacattacagataatcaaggt

SEQ ID NO: 784 - DNA, 46 bp, synthetic construct
  source 1..46: mol_type = other DNA; note = Description of Artificial Sequence: Synthetic primer
gttgatgacacattttattactggtaacattacagataatcaaggt

SEQ ID NO: 785 - DNA, 46 bp, synthetic construct
  source 1..46: mol_type = other DNA; note = Description of Artificial Sequence: Synthetic primer
gttgatgacacattttattactcataacattacagataatcaaggt

SEQ ID NO: 786 - DNA, 46 bp, synthetic construct
  source 1..46: mol_type = other DNA; note = Description of Artificial Sequence: Synthetic primer
gttgatgacacattttattactattaacattacagataatcaaggt

SEQ ID NO: 787 - DNA, 46 bp, synthetic construct
  source 1..46: mol_type = other DNA; note = Description of Artificial Sequence: Synthetic primer
gttgatgacacattttattactaaaaacattacagataatcaaggt

SEQ ID NO: 788 - DNA, 46 bp, synthetic construct
  source 1..46: mol_type = other DNA; note = Description of Artificial Sequence: Synthetic primer
gttgatgacacattttattactttgaacattacagataatcaaggt

SEQ ID NO: 789 - DNA, 46 bp, synthetic construct
  source 1..46: mol_type = other DNA; note = Description of Artificial Sequence: Synthetic primer
gttgatgacacattttattactatgaacattacagataatcaaggt

SEQ ID NO: 790 - DNA, 46 bp, synthetic construct
  source 1..46: mol_type = other DNA; note = Description of Artificial Sequence: Synthetic primer
gttgatgacacattttattactaataacattacagataatcaaggt

SEQ ID NO: 791 - DNA, 46 bp, synthetic construct
  source 1..46: mol_type = other DNA; note = Description of Artificial Sequence: Synthetic primer
gttgatgacacattttattactccaaacattacagataatcaaggt

SEQ ID NO: 792 - DNA, 46 bp, synthetic construct
  source 1..46: mol_type = other DNA; note = Description of Artificial Sequence: Synthetic primer
gttgatgacacattttattactcaaaacattacagataatcaaggt

SEQ ID NO: 793 - DNA, 46 bp, synthetic construct
  source 1..46: mol_type = other DNA; note = Description of Artificial Sequence: Synthetic primer
gttgatgacacattttattactagaaacattacagataatcaaggt

SEQ ID NO: 794 - DNA, 46 bp, synthetic construct
  source 1..46: mol_type = other DNA; note = Description of Artificial Sequence: Synthetic primer
gttgatgacacattttattacttctaacattacagataatcaaggt

SEQ ID NO: 795 - DNA, 46 bp, synthetic construct
  source 1..46: mol_type = other DNA; note = Description of Artificial Sequence: Synthetic primer
gttgatgacacattttattactactaacattacagataatcaaggt

SEQ ID NO: 796 - DNA, 46 bp, synthetic construct
  source 1..46: mol_type = other DNA; note = Description of Artificial Sequence: Synthetic primer
gttgatgacacattttattactgttaacattacagataatcaaggt

SEQ ID NO: 797 - DNA, 46 bp, synthetic construct
  source 1..46: mol_type = other DNA; note = Description of Artificial Sequence: Synthetic primer
gttgatgacacattttattacttggaacattacagataatcaaggt

SEQ ID NO: 798 - DNA, 46 bp, synthetic construct
  source 1..46: mol_type = other DNA; note = Description of Artificial Sequence: Synthetic primer
gttgatgacacattttattacttataacattacagataatcaaggt

SEQ ID NO: 799 - DNA, 49 bp, synthetic construct
  source 1..49: mol_type = other DNA; note = Description of Artificial Sequence: Synthetic primer
cttgttggacaggtcagccggtgctaatggagccttcaagataaaattg

SEQ ID NO: 800 - DNA, 49 bp, synthetic construct
  source 1..49: mol_type = other DNA; note = Description of Artificial Sequence: Synthetic primer
cttgttggacaggtcagccggttgtaatggagccttcaagataaaattg

SEQ ID NO: 801 - DNA, 49 bp, synthetic construct
  source 1..49: mol_type = other DNA; note = Description of Artificial Sequence: Synthetic primer
cttgttggacaggtcagccggtgataatggagccttcaagataaaattg

SEQ ID NO: 802 - DNA, 49 bp, synthetic construct
  source 1..49: mol_type = other DNA; note = Description of Artificial Sequence: Synthetic primer
cttgttggacaggtcagccggtgaaaatggagccttcaagataaaattg

SEQ ID NO: 803 - DNA, 49 bp, synthetic construct
  source 1..49: mol_type = other DNA; note = Description of Artificial Sequence: Synthetic primer
cttgttggacaggtcagccggttttaatggagccttcaagataaaattg

SEQ ID NO: 804 - DNA, 49 bp, synthetic construct
  source 1..49: mol_type = other DNA; note = Description of Artificial Sequence: Synthetic primer
cttgttggacaggtcagccggtggtaatggagccttcaagataaaattg

SEQ ID NO: 805 - DNA, 49 bp, synthetic construct
  source 1..49: mol_type = other DNA; note = Description of Artificial Sequence: Synthetic primer
cttgttggacaggtcagccggtcataatggagccttcaagataaaattg

SEQ ID NO: 806 - DNA, 49 bp, synthetic construct
  source 1..49: mol_type = other DNA; note = Description of Artificial Sequence: Synthetic primer
cttgttggacaggtcagccggtattaatggagccttcaagataaaattg

SEQ ID NO: 807 - DNA, 49 bp, synthetic construct
  source 1..49: mol_type = other DNA; note = Description of Artificial Sequence: Synthetic primer
cttgttggacaggtcagccggtaaaaatggagccttcaagataaaattg

SEQ ID NO: 808 - DNA, 49 bp, synthetic construct
  source 1..49: mol_type = other DNA; note = Description of Artificial Sequence: Synthetic primer
cttgttggacaggtcagccggtttgaatggagccttcaagataaaattg

SEQ ID NO: 809 - DNA, 49 bp, synthetic construct
  source 1..49: mol_type = other DNA; note = Description of Artificial Sequence: Synthetic primer
cttgttggacaggtcagccggtatgaatggagccttcaagataaaattg

SEQ ID NO: 810 - DNA, 49 bp, synthetic construct
  source 1..49: mol_type = other DNA; note = Description of Artificial Sequence: Synthetic primer
cttgttggacaggtcagccggtaataatggagccttcaagataaaattg

SEQ ID NO: 811 - DNA, 49 bp, synthetic construct
  source 1..49: mol_type = other DNA; note = Description of Artificial Sequence: Synthetic primer
cttgttggacaggtcagccggtccaaatggagccttcaagataaaattg

SEQ ID NO: 812 - DNA, 49 bp, synthetic construct
  source 1..49: mol_type = other DNA; note = Description of Artificial Sequence: Synthetic primer
cttgttggacaggtcagccggtcaaaatggagccttcaagataaaattg

SEQ ID NO: 813 - DNA, 49 bp, synthetic construct
  source 1..49: mol_type = other DNA; note = Description of Artificial Sequence: Synthetic primer
cttgttggacaggtcagccggtagaaatggagccttcaagataaaattg

SEQ ID NO: 814 - DNA, 49 bp, synthetic construct
  source 1..49: mol_type = other DNA; note = Description of Artificial Sequence: Synthetic primer
cttgttggacaggtcagccggttctaatggagccttcaagataaaattg

SEQ ID NO: 815 - DNA, 49 bp, synthetic construct
  source 1..49: mol_type = other DNA; note = Description of Artificial Sequence: Synthetic primer
cttgttggacaggtcagccggtactaatggagccttcaagataaaattg

SEQ ID NO: 816 - DNA, 49 bp, synthetic construct
  source 1..49: mol_type = other DNA; note = Description of Artificial Sequence: Synthetic primer
cttgttggacaggtcagccggtgttaatggagccttcaagataaaattg

SEQ ID NO: 817 - DNA, 49 bp, synthetic construct
  source 1..49: mol_type = other DNA; note = Description of Artificial Sequence: Synthetic primer
cttgttggacaggtcagccggttggaatggagccttcaagataaaattg

SEQ ID NO: 818 - DNA, 49 bp, synthetic construct
  source 1..49: mol_type = other DNA; note = Description of Artificial Sequence: Synthetic primer
cttgttggacaggtcagccggttataatggagccttcaagataaaattg

SEQ ID NO: 819 - DNA, 46 bp, synthetic construct
  source 1..46: mol_type = other DNA; note = Description of Artificial Sequence: Synthetic primer
ttggacaggtcagccggtcaagctggagccttcaagataaaattgg

SEQ ID NO: 820 - DNA, 46 bp, synthetic construct
  source 1..46: mol_type = other DNA; note = Description of Artificial Sequence: Synthetic primer
ttggacaggtcagccggtcaatgtggagccttcaagataaaattgg

SEQ ID NO: 821 - DNA, 46 bp, synthetic construct
  source 1..46: mol_type = other DNA; note = Description of Artificial Sequence: Synthetic primer
ttggacaggtcagccggtcaagatggagccttcaagataaaattgg

SEQ ID NO: 822 - DNA, 46 bp, synthetic construct
  source 1..46: mol_type = other DNA; note = Description of Artificial Sequence: Synthetic primer
ttggacaggtcagccggtcaagaaggagccttcaagataaaattgg

SEQ ID NO: 823 - DNA, 46 bp, synthetic construct
  source 1..46: mol_type = other DNA; note = Description of Artificial Sequence: Synthetic primer
ttggacaggtcagccggtcaatttggagccttcaagataaaattgg

SEQ ID NO: 824 - DNA, 46 bp, synthetic construct
  source 1..46: mol_type = other DNA; note = Description of Artificial Sequence: Synthetic primer
ttggacaggtcagccggtcaaggtggagccttcaagataaaattgg

SEQ ID NO: 825 - DNA, 46 bp, synthetic construct
  source 1..46: mol_type = other DNA; note = Description of Artificial Sequence: Synthetic primer
ttggacaggtcagccggtcaacatggagccttcaagataaaattgg

SEQ ID NO: 826 - DNA, 46 bp, synthetic construct
  source 1..46: mol_type = other DNA; note = Description of Artificial Sequence: Synthetic primer
ttggacaggtcagccggtcaaattggagccttcaagataaaattgg

SEQ ID NO: 827 - DNA, 46 bp, synthetic construct
  source 1..46: mol_type = other DNA; note = Description of Artificial Sequence: Synthetic primer
ttggacaggtcagccggtcaaaaaggagccttcaagataaaattgg

SEQ ID NO: 828 - DNA, 46 bp, synthetic construct
  source 1..46: mol_type = other DNA; note = Description of Artificial Sequence: Synthetic primer
ttggacaggtcagccggtcaattgggagccttcaagataaaattgg

SEQ ID NO: 829 - DNA, 46 bp, synthetic construct
  source 1..46: mol_type = other DNA; note = Description of Artificial Sequence: Synthetic primer
ttggacaggtcagccggtcaaatgggagccttcaagataaaattgg

SEQ ID NO: 830 - DNA, 46 bp, synthetic construct
  source 1..46: mol_type = other DNA; note = Description of Artificial Sequence: Synthetic primer
ttggacaggtcagccggtcaaaatggagccttcaagataaaattgg

SEQ ID NO: 831 - DNA, 46 bp, synthetic construct
  source 1..46: mol_type = other DNA; note = Description of Artificial Sequence: Synthetic primer
ttggacaggtcagccggtcaaccaggagccttcaagataaaattgg

SEQ ID NO: 832 - DNA, 46 bp, synthetic construct
  source 1..46: mol_type = other DNA; note = Description of Artificial Sequence: Synthetic primer
ttggacaggtcagccggtcaacaaggagccttcaagataaaattgg

SEQ ID NO: 833 - DNA, 46 bp, synthetic construct
  source 1..46: mol_type = other DNA; note = Description of Artificial Sequence: Synthetic primer
ttggacaggtcagccggtcaaagaggagccttcaagataaaattgg

SEQ ID NO: 834 - DNA, 46 bp, synthetic construct
  source 1..46: mol_type = other DNA; note = Description of Artificial Sequence: Synthetic primer
ttggacaggtcagccggtcaatctggagccttcaagataaaattgg

SEQ ID NO: 835 - DNA, 46 bp, synthetic construct
  source 1..46: mol_type = other DNA; note = Description of Artificial Sequence: Synthetic primer
ttggacaggtcagccggtcaaactggagccttcaagataaaattgg

SEQ ID NO: 836 - DNA, 46 bp, synthetic construct
  source 1..46: mol_type = other DNA; note = Description of Artificial Sequence: Synthetic primer
ttggacaggtcagccggtcaagttggagccttcaagataaaattgg

SEQ ID NO: 837 - DNA, 46 bp, synthetic construct
  source 1..46: mol_type = other DNA; note = Description of Artificial Sequence: Synthetic primer
ttggacaggtcagccggtcaatggggagccttcaagataaaattgg

SEQ ID NO: 838 - DNA, 46 bp, synthetic construct
  source 1..46: mol_type = other DNA; note = Description of Artificial Sequence: Synthetic primer
ttggacaggtcagccggtcaatatggagccttcaagataaaattgg

SEQ ID NO: 839 - DNA, 43 bp, synthetic construct
  source 1..43: mol_type = other DNA; note = Description of Artificial Sequence: Synthetic primer
caatcttgaactcaacaatagctaacttgagatttatctcaga

SEQ ID NO: 840 - DNA, 43 bp, synthetic construct
  source 1..43: mol_type = other DNA; note = Description of Artificial Sequence: Synthetic primer
caatcttgaactcaacaatatgtaacttgagatttatctcaga

SEQ ID NO: 841 - DNA, 43 bp, synthetic construct
  source 1..43: mol_type = other DNA; note = Description of Artificial Sequence: Synthetic primer
caatcttgaactcaacaatagataacttgagatttatctcaga

SEQ ID NO: 842 - DNA, 43 bp, synthetic construct
  source 1..43: mol_type = other DNA; note = Description of Artificial Sequence: Synthetic primer
caatcttgaactcaacaatagaaaacttgagatttatctcaga

SEQ ID NO: 843 - DNA, 43 bp, synthetic construct
  source 1..43: mol_type = other DNA; note = Description of Artificial Sequence: Synthetic primer
caatcttgaactcaacaatatttaacttgagatttatctcaga

SEQ ID NO: 844 - DNA, 43 bp, synthetic construct
  source 1..43: mol_type = other DNA; note = Description of Artificial Sequence: Synthetic primer
caatcttgaactcaacaataggtaacttgagatttatctcaga

SEQ ID NO: 845 - DNA, 43 bp, synthetic construct
  source 1..43: mol_type = other DNA; note = Description of Artificial Sequence: Synthetic primer
caatcttgaactcaacaatacataacttgagatttatctcaga

SEQ ID NO: 846 - DNA, 43 bp, synthetic construct
  source 1..43: mol_type = other DNA; note = Description of Artificial Sequence: Synthetic primer
caatcttgaactcaacaataattaacttgagatttatctcaga

SEQ ID NO: 847 - DNA, 43 bp, synthetic construct
  source 1..43: mol_type = other DNA; note = Description of Artificial Sequence: Synthetic primer
caatcttgaactcaacaataaaaaacttgagatttatctcaga

SEQ ID NO: 848 - DNA, 43 bp, synthetic construct
  source 1..43: mol_type = other DNA; note = Description of Artificial Sequence: Synthetic primer
caatcttgaactcaacaatattgaacttgagatttatctcaga

SEQ ID NO: 849 - DNA, 43 bp, synthetic construct
  source 1..43: mol_type = other DNA; note = Description of Artificial Sequence: Synthetic primer
caatcttgaactcaacaataatgaacttgagatttatctcaga

SEQ ID NO: 850 - DNA, 43 bp, synthetic construct
  source 1..43: mol_type = other DNA; note = Description of Artificial Sequence: Synthetic primer
caatcttgaactcaacaataaataacttgagatttatctcaga

SEQ ID NO: 851 - DNA, 43 bp, synthetic construct
  source 1..43: mol_type = other DNA; note = Description of Artificial Sequence: Synthetic primer
caatcttgaactcaacaataccaaacttgagatttatctcaga

SEQ ID NO: 852 - DNA, 43 bp, synthetic construct
  source 1..43: mol_type = other DNA; note = Description of Artificial Sequence: Synthetic primer
caatcttgaactcaacaatacaaaacttgagatttatctcaga

SEQ ID NO: 853 - DNA, 43 bp, synthetic construct
  source 1..43: mol_type = other DNA; note = Description of Artificial Sequence: Synthetic primer
caatcttgaactcaacaataagaaacttgagatttatctcaga

SEQ ID NO: 854 - DNA, 43 bp, synthetic construct
  source 1..43: mol_type = other DNA; note = Description of Artificial Sequence: Synthetic primer
caatcttgaactcaacaatatctaacttgagatttatctcaga

SEQ ID NO: 855 - DNA, 43 bp, synthetic construct
  source 1..43: mol_type = other DNA; note = Description of Artificial Sequence: Synthetic primer
caatcttgaactcaacaataactaacttgagatttatctcaga

SEQ ID NO: 856 - DNA, 43 bp, synthetic construct
  source 1..43: mol_type = other DNA; note = Description of Artificial Sequence: Synthetic primer
caatcttgaactcaacaatagttaacttgagatttatctcaga

SEQ ID NO: 857 - DNA, 43 bp, synthetic construct
  source 1..43: mol_type = other DNA; note = Description of Artificial Sequence: Synthetic primer
caatcttgaactcaacaatatggaacttgagatttatctcaga

SEQ ID NO: 858 - DNA, 43 bp, synthetic construct
  source 1..43: mol_type = other DNA; note = Description of Artificial Sequence: Synthetic primer
caatcttgaactcaacaatatataacttgagatttatctcaga

SEQ ID NO: 859 - DNA, 43 bp, synthetic construct
  source 1..43: mol_type = other DNA; note = Description of Artificial Sequence: Synthetic primer
gaggatactgtcctaccgtagctgtaggtggtcatttttctgg

SEQ ID NO: 860 - DNA, 43 bp, synthetic construct
  source 1..43: mol_type = other DNA; note = Description of Artificial Sequence: Synthetic primer
gaggatactgtcctaccgtatgtgtaggtggtcatttttctgg

SEQ ID NO: 861 - DNA, 43 bp, synthetic construct
  source 1..43: mol_type = other DNA; note = Description of Artificial Sequence: Synthetic primer
gaggatactgtcctaccgtagatgtaggtggtcatttttctgg

SEQ ID NO: 862 - DNA, 43 bp, synthetic construct
  source 1..43: mol_type = other DNA; note = Description of Artificial Sequence: Synthetic primer
gaggatactgtcctaccgtagaagtaggtggtcatttttctgg

SEQ ID NO: 863 - DNA, 43 bp, synthetic construct
  source 1..43: mol_type = other DNA; note = Description of Artificial Sequence: Synthetic primer
gaggatactgtcctaccgtatttgtaggtggtcatttttctgg

SEQ ID NO: 864 - DNA, 43 bp, synthetic construct
  source 1..43: mol_type = other DNA; note = Description of Artificial Sequence: Synthetic primer
gaggatactgtcctaccgtaggtgtaggtggtcatttttctgg

SEQ ID NO: 865 - DNA, 43 bp, synthetic construct
  source 1..43: mol_type = other DNA; note = Description of Artificial Sequence: Synthetic primer
gaggatactgtcctaccgtacatgtaggtggtcatttttctgg

SEQ ID NO: 866 - DNA, 43 bp, synthetic construct
  source 1..43: mol_type = other DNA; note = Description of Artificial Sequence: Synthetic primer
gaggatactgtcctaccgtaattgtaggtggtcatttttctgg

SEQ ID NO: 867 - DNA, 43 bp, synthetic construct
  source 1..43: mol_type = other DNA; note = Description of Artificial Sequence: Synthetic primer
gaggatactgtcctaccgtaaaagtaggtggtcatttttctgg

SEQ ID NO: 868 - DNA, 43 bp, synthetic construct
  source 1..43: mol_type = other DNA; note = Description of Artificial Sequence: Synthetic primer
gaggatactgtcctaccgtattggtaggtggtcatttttctgg

SEQ ID NO: 869 - DNA, 43 bp, synthetic construct
  source 1..43: mol_type = other DNA; note = Description of Artificial Sequence: Synthetic primer
gaggatactgtcctaccgtaatggtaggtggtcatttttctgg

SEQ ID NO: 870 - DNA, 43 bp, synthetic construct
  source 1..43: mol_type = other DNA; note = Description of Artificial Sequence: Synthetic primer
gaggatactgtcctaccgtaaatgtaggtggtcatttttctgg

SEQ ID NO: 871 - DNA, 43 bp, synthetic construct
  source 1..43: mol_type = other DNA; note = Description of Artificial Sequence: Synthetic primer
gaggatactgtcctaccgtaccagtaggtggtcatttttctgg

SEQ ID NO: 872 - DNA, 43 bp, synthetic construct
  source 1..43: mol_type = other DNA; note = Description of Artificial Sequence: Synthetic primer
gaggatactgtcctaccgtacaagtaggtggtcatttttctgg

SEQ ID NO: 873 - DNA, 43 bp, synthetic construct
  source 1..43: mol_type = other DNA; note = Description of Artificial Sequence: Synthetic primer
gaggatactgtcctaccgtaagagtaggtggtcatttttctgg

SEQ ID NO: 874 - DNA, 43 bp, synthetic construct
  source 1..43: mol_type = other DNA; note = Description of Artificial Sequence: Synthetic primer
gaggatactgtcctaccgtatctgtaggtggtcatttttctgg

SEQ ID NO: 875 - DNA, 43 bp, synthetic construct
  source 1..43: mol_type = other DNA; note = Description of Artificial Sequence: Synthetic primer
gaggatactgtcctaccgtaactgtaggtggtcatttttctgg

SEQ ID NO: 876 - DNA, 43 bp, synthetic construct
  source 1..43: mol_type = other DNA; note = Description of Artificial Sequence: Synthetic primer
gaggatactgtcctaccgtagttgtaggtggtcatttttctgg

SEQ ID NO: 877 - DNA, 43 bp, synthetic construct
  source 1..43: mol_type = other DNA; note = Description of Artificial Sequence: Synthetic primer
gaggatactgtcctaccgtatgggtaggtggtcatttttctgg

SEQ ID NO: 878 - DNA, 43 bp, synthetic construct
  source 1..43: mol_type = other DNA; note = Description of Artificial Sequence: Synthetic primer
gaggatactgtcctaccgtatatgtaggtggtcatttttctgg

SEQ ID NO: 879 - DNA, 46 bp, synthetic construct
  source 1..46: mol_type = other DNA; note = Description of Artificial Sequence: Synthetic primer
cgtaggagcaggtatgtacgctttgtatccttacggtggaattatg

SEQ ID NO: 880 - DNA, 46 bp, synthetic construct
  source 1..46: mol_type = other DNA; note = Description of Artificial Sequence: Synthetic primer
cgtaggagcaggtatgtactgtttgtatccttacggtggaattatg

SEQ ID NO: 881 - DNA, 46 bp, synthetic construct
  source 1..46: mol_type = other DNA; note = Description of Artificial Sequence: Synthetic primer
cgtaggagcaggtatgtacgatttgtatccttacggtggaattatg

SEQ ID NO: 882 - DNA, 46 bp, synthetic construct
  source 1..46: mol_type = other DNA; note = Description of Artificial Sequence: Synthetic primer
cgtaggagcaggtatgtacgaattgtatccttacggtggaattatg

SEQ ID NO: 883 - DNA, 46 bp, synthetic construct
  source 1..46: mol_type = other DNA; note = Description of Artificial Sequence: Synthetic primer
cgtaggagcaggtatgtactttttgtatccttacggtggaattatg

SEQ ID NO: 884 - DNA, 46 bp, synthetic construct
  source 1..46: mol_type = other DNA; note = Description of Artificial Sequence: Synthetic primer
cgtaggagcaggtatgtacggtttgtatccttacggtggaattatg

SEQ ID NO: 885 - DNA, 46 bp, synthetic construct
  source 1..46: mol_type = other DNA; note = Description of Artificial Sequence: Synthetic primer
cgtaggagcaggtatgtaccatttgtatccttacggtggaattatg

SEQ ID NO: 886 - DNA, 46 bp, synthetic construct
  source 1..46: mol_type = other DNA; note = Description of Artificial Sequence: Synthetic primer
cgtaggagcaggtatgtacattttgtatccttacggtggaattatg

SEQ ID NO: 887 - DNA, 46 bp, synthetic construct
  source 1..46: mol_type = other DNA; note = Description of Artificial Sequence: Synthetic primer
cgtaggagcaggtatgtacaaattgtatccttacggtggaattatg

SEQ ID NO: 888 - DNA, 46 bp, synthetic construct
  source 1..46: mol_type = other DNA; note = Description of Artificial Sequence: Synthetic primer
cgtaggagcaggtatgtacttgttgtatccttacggtggaattatg

SEQ ID NO: 889 - DNA, 46 bp, synthetic construct
  source 1..46: mol_type = other DNA; note = Description of Artificial Sequence: Synthetic primer
cgtaggagcaggtatgtacatgttgtatccttacggtggaattatg

SEQ ID NO: 890 - DNA, 46 bp, synthetic construct
  source 1..46: mol_type = other DNA; note = Description of Artificial Sequence: Synthetic primer
cgtaggagcaggtatgtacaatttgtatccttacggtggaattatg

SEQ ID NO: 891 - DNA, 46 bp, synthetic construct
  source 1..46: mol_type = other DNA; note = Description of Artificial Sequence: Synthetic primer
cgtaggagcaggtatgtacccattgtatccttacggtggaattatg

SEQ ID NO: 892 - DNA, 46 bp, synthetic construct
  source 1..46: mol_type = other DNA; note = Description of Artificial Sequence: Synthetic primer
cgtaggagcaggtatgtaccaattgtatccttacggtggaattatg

SEQ ID NO: 893 - DNA, 46 bp, synthetic construct
  source 1..46: mol_type = other DNA; note = Description of Artificial Sequence: Synthetic primer
cgtaggagcaggtatgtacagattgtatccttacggtggaattatg

SEQ ID NO: 894 - DNA, 46 bp, synthetic construct
  source 1..46: mol_type = other DNA; note = Description of Artificial Sequence: Synthetic primer
cgtaggagcaggtatgtactctttgtatccttacggtggaattatg

SEQ ID NO: 895 - DNA, 46 bp, synthetic construct
  source 1..46: mol_type = other DNA; note = Description of Artificial Sequence: Synthetic primer
cgtaggagcaggtatgtacactttgtatccttacggtggaattatg

SEQ ID NO: 896 - DNA, 46 bp, synthetic construct
  source 1..46: mol_type = other DNA; note = Description of Artificial Sequence: Synthetic primer
cgtaggagcaggtatgtacgttttgtatccttacggtggaattatg

SEQ ID NO: 897 - DNA, 46 bp, synthetic construct
  source 1..46: mol_type = other DNA; note = Description of Artificial Sequence: Synthetic primer
cgtaggagcaggtatgtactggttgtatccttacggtggaattatg

SEQ ID NO: 898 - DNA, 46 bp, synthetic construct
  source 1..46: mol_type = other DNA; note = Description of Artificial Sequence: Synthetic primer
cgtaggagcaggtatgtactatttgtatccttacggtggaattatg

SEQ ID NO: 899 - DNA, 45 bp, synthetic construct
  source 1..45: mol_type = other DNA; note = Description of Artificial Sequence: Synthetic primer
tcatgtatgaattgtggtacgctgcctcttgggaaaaacaagaag

SEQ ID NO: 900 - DNA, 45 bp, synthetic construct
  source 1..45: mol_type = other DNA; note = Description of Artificial Sequence: Synthetic primer
tcatgtatgaattgtggtactgtgcctcttgggaaaaacaagaag

SEQ ID NO: 901 - DNA, 45 bp, synthetic construct
  source 1..45: mol_type = other DNA; note = Description of Artificial Sequence: Synthetic primer
tcatgtatgaattgtggtacgatgcctcttgggaaaaacaagaag

SEQ ID NO: 902 - DNA, 45 bp, synthetic construct
  source 1..45: mol_type = other DNA; note = Description of Artificial Sequence: Synthetic primer
tcatgtatgaattgtggtacgaagcctcttgggaaaaacaagaag

SEQ ID NO: 903 - DNA, 45 bp, synthetic construct
  source 1..45: mol_type = other DNA; note = Description of Artificial Sequence: Synthetic primer
tcatgtatgaattgtggtactttgcctcttgggaaaaacaagaag

SEQ ID NO: 904 - DNA, 45 bp, synthetic construct
  source 1..45: mol_type = other DNA; note = Description of Artificial Sequence: Synthetic primer
tcatgtatgaattgtggtacggtgcctcttgggaaaaacaagaag

SEQ ID NO: 905 - DNA, 45 bp, synthetic construct
  source 1..45: mol_type = other DNA; note = Description of Artificial Sequence: Synthetic primer
tcatgtatgaattgtggtaccatgcctcttgggaaaaacaagaag

SEQ ID NO: 906 - DNA, 45 bp, synthetic construct
  source 1..45: mol_type = other DNA; note = Description of Artificial Sequence: Synthetic primer
tcatgtatgaattgtggtacattgcctcttgggaaaaacaagaag

SEQ ID NO: 907 - DNA, 45 bp, synthetic construct
  source 1..45: mol_type = other DNA; note = Description of Artificial Sequence: Synthetic primer
tcatgtatgaattgtggtacaaagcctcttgggaaaaacaagaag

SEQ ID NO: 908 - DNA, 45 bp, synthetic construct
  source 1..45: mol_type = other DNA; note = Description of Artificial Sequence: Synthetic primer
tcatgtatgaattgtggtacttggcctcttgggaaaaacaagaag

SEQ ID NO: 909 - DNA, 45 bp, synthetic construct
  source 1..45: mol_type = other DNA; note = Description of Artificial Sequence: Synthetic primer
tcatgtatgaattgtggtacatggcctcttgggaaaaacaagaag

SEQ ID NO: 910 - DNA, 45 bp, synthetic construct
  source 1..45: mol_type = other DNA; note = Description of Artificial Sequence: Synthetic primer
tcatgtatgaattgtggtacaatgcctcttgggaaaaacaagaag

SEQ ID NO: 911 - DNA, 45 bp, synthetic construct
  source 1..45: mol_type = other DNA; note = Description of Artificial Sequence: Synthetic primer
tcatgtatgaattgtggtacccagcctcttgggaaaaacaagaag

SEQ ID NO: 912 - DNA, 45 bp, synthetic construct
  source 1..45: mol_type = other DNA; note = Description of Artificial Sequence: Synthetic primer
tcatgtatgaattgtggtaccaagcctcttgggaaaaacaagaag

SEQ ID NO: 913 - DNA, 45 bp, synthetic construct
  source 1..45: mol_type = other DNA; note = Description of Artificial Sequence: Synthetic primer
tcatgtatgaattgtggtacagagcctcttgggaaaaacaagaag

SEQ ID NO: 914 - DNA, 45 bp, synthetic construct
  source 1..45: mol_type = other DNA; note = Description of Artificial Sequence: Synthetic primer
tcatgtatgaattgtggtactctgcctcttgggaaaaacaagaag

SEQ ID NO: 915 - DNA, 45 bp, synthetic construct
  source 1..45: mol_type = other DNA; note = Description of Artificial Sequence: Synthetic primer
tcatgtatgaattgtggtacactgcctcttgggaaaaacaagaag

SEQ ID NO: 916 - DNA, 45 bp, synthetic construct
  source 1..45: mol_type = other DNA; note = Description of Artificial Sequence: Synthetic primer
tcatgtatgaattgtggtacgttgcctcttgggaaaaacaagaag

SEQ ID NO: 917 - DNA, 45 bp, synthetic construct
  source 1..45: mol_type = other DNA; note = Description of Artificial Sequence: Synthetic primer
tcatgtatgaattgtggtactgggcctcttgggaaaaacaagaag

SEQ ID NO: 918 - DNA, 45 bp, synthetic construct
  source 1..45: mol_type = other DNA; note = Description of Artificial Sequence: Synthetic primer
tcatgtatgaattgtggtactatgcctcttgggaaaaacaagaag

SEQ ID NO: 919 - DNA, 48 bp, synthetic construct
  source 1..48: mol_type = other DNA; note = Description of Artificial Sequence: Synthetic primer
tgcagtaccttctaagtcaactgctttctcagttaaaaagaacatgga

SEQ ID NO: 920 - DNA, 48 bp, synthetic construct
  source 1..48: mol_type = other DNA; note = Description of Artificial Sequence: Synthetic primer
tgcagtaccttctaagtcaacttgtttctcagttaaaaagaacatgga

SEQ ID NO: 921 - DNA, 48 bp, synthetic construct
  source 1..48: mol_type = other DNA; note = Description of Artificial Sequence: Synthetic primer
tgcagtaccttctaagtcaactgatttctcagttaaaaagaacatgga

SEQ ID NO: 922 - DNA, 48 bp, synthetic construct
  source 1..48: mol_type = other DNA; note = Description of Artificial Sequence: Synthetic primer
tgcagtaccttctaagtcaactgaattctcagttaaaaagaacatgga

SEQ ID NO: 923 - DNA, 48 bp, synthetic construct
  source 1..48: mol_type = other DNA; note = Description of Artificial Sequence: Synthetic primer
tgcagtaccttctaagtcaacttttttctcagttaaaaagaacatgga

SEQ ID NO: 924 - DNA, 48 bp, synthetic construct
  source 1..48: mol_type = other DNA; note = Description of Artificial Sequence: Synthetic primer
tgcagtaccttctaagtcaactggtttctcagttaaaaagaacatgga

SEQ ID NO: 925 - DNA, 48 bp, synthetic construct
  source 1..48: mol_type = other DNA; note = Description of Artificial Sequence: Synthetic primer
tgcagtaccttctaagtcaactcatttctcagttaaaaagaacatgga

SEQ ID NO: 926 - DNA, 48 bp, synthetic construct
  source 1..48: mol_type = other DNA; note = Description of Artificial Sequence: Synthetic primer
tgcagtaccttctaagtcaactattttctcagttaaaaagaacatgga

SEQ ID NO: 927 - DNA, 48 bp, synthetic construct
  source 1..48: mol_type = other DNA; note = Description of Artificial Sequence: Synthetic primer
tgcagtaccttctaagtcaactaaattctcagttaaaaagaacatgga

SEQ ID NO: 928 - DNA, 48 bp, synthetic construct
  source 1..48: mol_type = other DNA; note = Description of Artificial Sequence: Synthetic primer
tgcagtaccttctaagtcaactttgttctcagttaaaaagaacatgga

SEQ ID NO: 929 - DNA, 48 bp, synthetic construct
  source 1..48: mol_type = other DNA; note = Description of Artificial Sequence: Synthetic primer
tgcagtaccttctaagtcaactatgttctcagttaaaaagaacatgga

SEQ ID NO: 930 - DNA, 48 bp, synthetic construct
  source 1..48: mol_type = other DNA; note = Description of Artificial Sequence: Synthetic primer
tgcagtaccttctaagtcaactaatttctcagttaaaaagaacatgga

SEQ ID NO: 931 - DNA, 48 bp, synthetic construct
  source 1..48: mol_type = other DNA; note = Description of Artificial Sequence: Synthetic primer
tgcagtaccttctaagtcaactccattctcagttaaaaagaacatgga

SEQ ID NO: 932 - DNA, 48 bp, synthetic construct
  source 1..48: mol_type = other DNA; note = Description of Artificial Sequence: Synthetic primer
tgcagtaccttctaagtcaactcaattctcagttaaaaagaacatgga

SEQ ID NO: 933 - DNA, 48 bp, synthetic construct
  source 1..48: mol_type = other DNA; note = Description of Artificial Sequence: Synthetic primer
tgcagtaccttctaagtcaactagattctcagttaaaaagaacatgga

SEQ ID NO: 934 - DNA, 48 bp, synthetic construct
  source 1..48: mol_type = other DNA; note = Description of Artificial Sequence: Synthetic primer
tgcagtaccttctaagtcaacttctttctcagttaaaaagaacatgga

SEQ ID NO: 935 - DNA, 48 bp, synthetic construct
  source 1..48: mol_type = other DNA; note = Description of Artificial Sequence: Synthetic primer
tgcagtaccttctaagtcaactactttctcagttaaaaagaacatgga

SEQ ID NO: 936 - DNA, 48 bp, synthetic construct
  source 1..48: mol_type = other DNA; note = Description of Artificial Sequence: Synthetic primer
tgcagtaccttctaagtcaactgttttctcagttaaaaagaacatgga

SEQ ID NO: 937 - DNA, 48 bp, synthetic construct
  source 1..48: mol_type = other DNA; note = Description of Artificial Sequence: Synthetic primer
tgcagtaccttctaagtcaacttggttctcagttaaaaagaacatgga

SEQ ID NO: 938 - DNA, 48 bp, synthetic construct
  source 1..48: mol_type = other DNA; note = Description of Artificial Sequence: Synthetic primer
tgcagtaccttctaagtcaacttatttctcagttaaaaagaacatgga

SEQ ID NO: 939 - DNA, 47 bp, synthetic construct
  source 1..47: mol_type = other DNA; note = Description of Artificial Sequence: Synthetic primer
gtcttaatgactcattttattactgctaacattacagataatcacgg

SEQ ID NO: 940 - DNA, 47 bp, synthetic construct
  source 1..47: mol_type = other DNA; note = Description of Artificial Sequence: Synthetic primer
gtcttaatgactcattttattacttgtaacattacagataatcacgg

SEQ ID NO: 941 - DNA, 47 bp, synthetic construct
  source 1..47: mol_type = other DNA; note = Description of Artificial Sequence: Synthetic primer
gtcttaatgactcattttattactgataacattacagataatcacgg

SEQ ID NO: 942 - DNA, 47 bp, synthetic construct
  source 1..47: mol_type = other DNA; note = Description of Artificial Sequence: Synthetic primer
gtcttaatgactcattttattactgaaaacattacagataatcacgg

SEQ ID NO: 943 - DNA, 47 bp, synthetic construct
  source 1..47: mol_type = other DNA; note = Description of Artificial Sequence: Synthetic primer
gtcttaatgactcattttattacttttaacattacagataatcacgg

SEQ ID NO: 944 - DNA, 47 bp, synthetic construct
  source 1..47: mol_type = other DNA; note = Description of Artificial Sequence: Synthetic primer
gtcttaatgactcattttattactggtaacattacagataatcacgg

SEQ ID NO: 945 - DNA, 47 bp, synthetic construct
  source 1..47: mol_type = other DNA; note = Description of Artificial Sequence: Synthetic primer
gtcttaatgactcattttattactcataacattacagataatcacgg

SEQ ID NO: 946 - DNA, 47 bp, synthetic construct
  source 1..47: mol_type = other DNA; note = Description of Artificial Sequence: Synthetic primer
gtcttaatgactcattttattactattaacattacagataatcacgg

SEQ ID NO: 947 - DNA, 47 bp, synthetic construct
  source 1..47: mol_type = other DNA; note = Description of Artificial Sequence: Synthetic primer
gtcttaatgactcattttattactaaaaacattacagataatcacgg

SEQ ID NO: 948 - DNA, 47 bp, synthetic construct
  source 1..47: mol_type = other DNA; note = Description of Artificial Sequence: Synthetic primer
gtcttaatgactcattttattactttgaacattacagataatcacgg

SEQ ID NO: 949 - DNA, 47 bp, synthetic construct
  source 1..47: mol_type = other DNA; note = Description of Artificial Sequence: Synthetic primer
gtcttaatgactcattttattactatgaacattacagataatcacgg

SEQ ID NO: 950 - DNA, 47 bp, synthetic construct
  source 1..47: mol_type = other DNA; note = Description of Artificial Sequence: Synthetic primer
gtcttaatgactcattttattactaataacattacagataatcacgg

SEQ ID NO: 951 - DNA, 47 bp, synthetic construct
  source 1..47: mol_type = other DNA; note = Description of Artificial Sequence: Synthetic primer
gtcttaatgactcattttattactccaaacattacagataatcacgg

SEQ ID NO: 952 - DNA, 47 bp, synthetic construct
  source 1..47: mol_type = other DNA; note = Description of Artificial Sequence: Synthetic primer
gtcttaatgactcattttattactcaaaacattacagataatcacgg

SEQ ID NO: 953 - DNA, 47 bp, synthetic construct
  source 1..47: mol_type = other DNA; note = Description of Artificial Sequence: Synthetic primer
gtcttaatgactcattttattactagaaacattacagataatcacgg

SEQ ID NO: 954 - DNA, 47 bp, synthetic construct
  source 1..47: mol_type = other DNA; note = Description of Artificial Sequence: Synthetic primer
gtcttaatgactcattttattacttctaacattacagataatcacgg

SEQ ID NO: 955 - DNA, 47 bp, synthetic construct
  source 1..47: mol_type = other DNA; note = Description of Artificial Sequence: Synthetic primer
gtcttaatgactcattttattactactaacattacagataatcacgg

SEQ ID NO: 956 - DNA, 47 bp, synthetic construct
  source 1..47: mol_type = other DNA; note = Description of Artificial Sequence: Synthetic primer
gtcttaatgactcattttattactgttaacattacagataatcacgg

SEQ ID NO: 957 - DNA, 47 bp, synthetic construct
  source 1..47: mol_type = other DNA; note = Description of Artificial Sequence: Synthetic primer
gtcttaatgactcattttattacttggaacattacagataatcacgg

SEQ ID NO: 958 - DNA, 47 bp, synthetic construct
  source 1..47: mol_type = other DNA; note = Description of Artificial Sequence: Synthetic primer
gtcttaatgactcattttattacttataacattacagataatcacgg

SEQ ID NO: 959 - DNA, 44 bp, synthetic construct
  source 1..44: mol_type = other DNA; note = Description of Artificial Sequence: Synthetic primer
tgttggatagatcagccggagctaagacagccttctctatcaag

SEQ ID NO: 960 - DNA, 44 bp, synthetic construct
  source 1..44: mol_type = other DNA; note = Description of Artificial Sequence: Synthetic primer
tgttggatagatcagccggatgtaagacagccttctctatcaag

SEQ ID NO: 961 - DNA, 44 bp, synthetic construct
  source 1..44: mol_type = other DNA; note = Description of Artificial Sequence: Synthetic primer
tgttggatagatcagccggagataagacagccttctctatcaag

SEQ ID NO: 962 - DNA, 44 bp, synthetic construct
  source 1..44: mol_type = other DNA; note = Description of Artificial Sequence: Synthetic primer
tgttggatagatcagccggagaaaagacagccttctctatcaag

SEQ ID NO: 963 - DNA, 44 bp, synthetic construct
  source 1..44: mol_type = other DNA; note = Description of Artificial Sequence: Synthetic primer
tgttggatagatcagccggatttaagacagccttctctatcaag

SEQ ID NO: 964 - DNA, 44 bp, synthetic construct
  source 1..44: mol_type = other DNA; note = Description of Artificial Sequence: Synthetic primer
tgttggatagatcagccggaggtaagacagccttctctatcaag

SEQ ID NO: 965 - DNA, 44 bp, synthetic construct
  source 1..44: mol_type = other DNA; note = Description of Artificial Sequence: Synthetic primer
tgttggatagatcagccggacataagacagccttctctatcaag

SEQ ID NO: 966 - DNA, 44 bp, synthetic construct
  source 1..44: mol_type = other DNA; note = Description of Artificial Sequence: Synthetic primer
tgttggatagatcagccggaattaagacagccttctctatcaag

SEQ ID NO: 967 - DNA, 44 bp, synthetic construct
  source 1..44: mol_type = other DNA; note = Description of Artificial Sequence: Synthetic primer
tgttggatagatcagccggaaaaaagacagccttctctatcaag

SEQ ID NO: 968 - DNA, 44 bp, synthetic construct
  source 1..44: mol_type = other DNA; note = Description of Artificial Sequence: Synthetic primer
tgttggatagatcagccggattgaagacagccttctctatcaag

SEQ ID NO: 969 - DNA, 44 bp, synthetic construct
  source 1..44: mol_type = other DNA; note = Description of Artificial Sequence: Synthetic primer
tgttggatagatcagccggaatgaagacagccttctctatcaag

SEQ ID NO: 970 - DNA, 44 bp, synthetic construct
  source 1..44: mol_type = other DNA; note = Description of Artificial Sequence: Synthetic primer
tgttggatagatcagccggaaataagacagccttctctatcaag

SEQ ID NO: 971 - DNA, 44 bp, synthetic construct
  source 1..44: mol_type = other DNA; note = Description of Artificial Sequence: Synthetic primer
tgttggatagatcagccggaccaaagacagccttctctatcaag

SEQ ID NO: 972 - DNA, 44 bp, synthetic construct
  source 1..44: mol_type = other DNA; note = Description of Artificial Sequence: Synthetic primer
tgttggatagatcagccggacaaaagacagccttctctatcaag

SEQ ID NO: 973 - DNA, 44 bp, synthetic construct
  source 1..44: mol_type = other DNA; note = Description of Artificial Sequence: Synthetic primer
tgttggatagatcagccggaagaaagacagccttctctatcaag

SEQ ID NO: 974 - DNA, 44 bp, synthetic construct
  source 1..44: mol_type = other DNA; note = Description of Artificial Sequence: Synthetic primer
tgttggatagatcagccggatctaagacagccttctctatcaag

SEQ ID NO: 975 - DNA, 44 bp, synthetic construct
  source 1..44: mol_type = other DNA; note = Description of Artificial Sequence: Synthetic primer
tgttggatagatcagccggaactaagacagccttctctatcaag

SEQ ID NO: 976 - DNA, 44 bp, synthetic construct
  source 1..44: mol_type = other DNA; note = Description of Artificial Sequence: Synthetic primer
tgttggatagatcagccggagttaagacagccttctctatcaag

SEQ ID NO: 977 - DNA, 44 bp, synthetic construct
  source 1..44: mol_type = other DNA; note = Description of Artificial Sequence: Synthetic primer
tgttggatagatcagccggatggaagacagccttctctatcaag

SEQ ID NO: 978 - DNA, 44 bp, synthetic construct
  source 1..44: mol_type = other DNA; note = Description of Artificial Sequence: Synthetic primer
tgttggatagatcagccggatataagacagccttctctatcaag

SEQ ID NO: 979 - DNA, 45 bp, synthetic construct
  source 1..45: mol_type = other DNA; note = Description of Artificial Sequence: Synthetic primer
tggatagatcagccggaaaagctacagccttctctatcaagttgg

SEQ ID NO: 980 - DNA, 45 bp, synthetic construct
  source 1..45: mol_type = other DNA; note = Description of Artificial Sequence: Synthetic primer
tggatagatcagccggaaaatgtacagccttctctatcaagttgg

SEQ ID NO: 981 - DNA, 45 bp, synthetic construct
  source 1..45: mol_type = other DNA; note = Description of Artificial Sequence: Synthetic primer
tggatagatcagccggaaaagatacagccttctctatcaagttgg

SEQ ID NO: 982 - DNA, 45 bp, synthetic construct
  source 1..45: mol_type = other DNA; note = Description of Artificial Sequence: Synthetic primer
tggatagatcagccggaaaagaaacagccttctctatcaagttgg

SEQ ID NO: 983 - DNA, 45 bp, synthetic construct
  source 1..45: mol_type = other DNA; note = Description of Artificial Sequence: Synthetic primer
tggatagatcagccggaaaatttacagccttctctatcaagttgg

SEQ ID NO: 984 - DNA, 45 bp, synthetic construct
  source 1..45: mol_type = other DNA; note = Description of Artificial Sequence: Synthetic primer
tggatagatcagccggaaaaggtacagccttctctatcaagttgg

SEQ ID NO: 985 - DNA, 45 bp, synthetic construct
  source 1..45: mol_type = other DNA; note = Description of Artificial Sequence: Synthetic primer
tggatagatcagccggaaaacatacagccttctctatcaagttgg

SEQ ID NO: 986 - DNA, 45 bp, synthetic construct
  source 1..45: mol_type = other DNA; note = Description of Artificial Sequence: Synthetic primer
tggatagatcagccggaaaaattacagccttctctatcaagttgg

SEQ ID NO: 987 - DNA, 45 bp, synthetic construct
  source 1..45: mol_type = other DNA; note = Description of Artificial Sequence: Synthetic primer
tggatagatcagccggaaaaaaaacagccttctctatcaagttgg

SEQ ID NO: 988 - DNA, 45 bp, synthetic construct
  source 1..45: mol_type = other DNA; note = Description of Artificial Sequence: Synthetic primer
tggatagatcagccggaaaattgacagccttctctatcaagttgg

SEQ ID NO: 989 - DNA, 45 bp, synthetic construct
  source 1..45: mol_type = other DNA; note = Description of Artificial Sequence: Synthetic primer
tggatagatcagccggaaaaatgacagccttctctatcaagttgg

SEQ ID NO: 990 - DNA, 45 bp, synthetic construct
  source 1..45: mol_type = other DNA; note = Description of Artificial Sequence: Synthetic primer
tggatagatcagccggaaaaaatacagccttctctatcaagttgg

SEQ ID NO: 991 - DNA, 45 bp, synthetic construct
  source 1..45: mol_type = other DNA; note = Description of Artificial Sequence: Synthetic primer
tggatagatcagccggaaaaccaacagccttctctatcaagttgg

SEQ ID NO: 992 - DNA, 45 bp, synthetic construct
  source 1..45: mol_type = other DNA; note = Description of Artificial Sequence: Synthetic primer
tggatagatcagccggaaaacaaacagccttctctatcaagttgg

SEQ ID NO: 993 - DNA, 45 bp, synthetic construct
  source 1..45: mol_type = other DNA; note = Description of Artificial Sequence: Synthetic primer
tggatagatcagccggaaaaagaacagccttctctatcaagttgg

SEQ ID NO: 994 - DNA, 45 bp, synthetic construct
  source 1..45: mol_type = other DNA; note = Description of Artificial Sequence: Synthetic primer
tggatagatcagccggaaaatctacagccttctctatcaagttgg

SEQ ID NO: 995 - DNA, 45 bp, synthetic construct
  source 1..45: mol_type = other DNA; note = Description of Artificial Sequence: Synthetic primer
tggatagatcagccggaaaaactacagccttctctatcaagttgg

SEQ ID NO: 996 - DNA, 45 bp, synthetic construct
  source 1..45: mol_type = other DNA; note = Description of Artificial Sequence: Synthetic primer
tggatagatcagccggaaaagttacagccttctctatcaagttgg

SEQ ID NO: 997 - DNA, 45 bp, synthetic construct
  source 1..45: mol_type = other DNA; note = Description of Artificial Sequence: Synthetic primer
tggatagatcagccggaaaatggacagccttctctatcaagttgg

SEQ ID NO: 998 - DNA, 45 bp, synthetic construct
  source 1..45: mol_type = other DNA; note = Description of Artificial Sequence: Synthetic primer
tggatagatcagccggaaaatatacagccttctctatcaagttgg

SEQ ID NO: 999 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 1000 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 1001 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 1002 - DNA, 1638 bp, synthetic construct
  source 1..1638: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattggtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccactaa

SEQ ID NO: 1003 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1004 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1005 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1006 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattggtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatctgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1007 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1008 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcacaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1009 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1010 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1011 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1012 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattggtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgccttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1013 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1014 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1015 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1016 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattggtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatgttttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1017 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattaaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1018 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattcaaaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1019 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattgttaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1020 - DNA, 1635 bp, synthetic construct
  source 1..1635: mol_type = other DNA; note = Description of Artificial Sequence: Synthetic polynucleotide
atgttctctttaaaggctttattgcctttggctttattattagtctctgctaaccaagtcgctgctaaagtaaacccaagagaaaactttttgaaatgtttttctcaatatatccctaacaatgctactaatttgaagttagtttacactcaaaataacccattgtatatgtcagtcttaaactcaaccattggtaatttaagatttacttctgacactaccccaaaaccattagtcattgtcacaccttcacacgtttctcatattcaaggaactatattatgttctaaaaaggttggtttgcaaattaggacaagatcaggtggtcacgactctgaaggtatgtcttatatctcacaagtaccattcgtcatagtagatttgagaaatatgagatcaattaagattgatgttcattctcagacagcctgggtagaagccggtgctactttaggagaagtttactattgggttaatgagaagaacgagaacttgtcattagcagcaggttactgcccaaccgtatgtgctggtggtcattttggtggtggtggatatggacctttgatgaggaattatggtttggctgctgataacattatagatgctcacttagttaatgttcacggtaaggtcttagacaggaagtctatgggagaagatttgttttgggcattgaggggaggtggtgcagagtctttcggtataatcgttgcctggaagattaggttggttgctgttccaaaatcaacaatgttttctgttaagaagataatggaaatccatgagttggttaaattggttaataagtggcaaaacatcgcctataagtacgacaaagacttattgttgatgacacattttattactaggaacattacagataatcaaggtaaaaacaaaactgctatacatacctacttctcttctgtattcttgggaggtgtcgattcattggttgatttaatgaataaatcttttcctgagttgggaataaaaaaaactgattgcagacaattgtcatggattgatacaattatattttattcaggagttgtcaactatgacactgataactttaataaagaaatcttgttggacaggtcagccggtcaaaatggagccttcaagataaaattggattatgttaagaaaccaattccagaatcagtatttgtccagattttggaaaaattatatgaagaagatataggtgcaggtatgtatattttatacccttatggtggtattatggacgaaatatctgaatcagctataccttttccacatagagctggtatattatatgaattgtggtacatgtgttcttgggagaaacaagaggataatgagaagcacttaaattggataagaaatatctataattttatgacaccatacgtttctaagaaccctagattggcatacttgaattacagagacttggatattggaattaacgatcctaaaaaccctaataattatacacaagctaggatttggggtgaaaaatacttcggtaagaactttgatagattagttaaggttaaaactttagtagatccaaataattttttcagaaatgagcaatcaattccaccattaccaagacacagacaccaccaccaccaccac

SEQ ID NO: 1021 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIKNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1022 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIQNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1023 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIVNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1024 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIGNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1025 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIKNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1026 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIQNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1027 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIVNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1028 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIGNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1029 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1030 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1031 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIKNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1032 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIQNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1033 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIVNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1034 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIGNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1035 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIKNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1036 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIQNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1037 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIVNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1038 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIGNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1039 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIKNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1040 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIQNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1041 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIVNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1042 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIGNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYILYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1043 - protein, 545 aa, unidentified
  source 1..545: note = Description of Unknown: CBDAS sequence
  VARIANT 252: note = MOD_RES - Any amino acid
  VARIANT 253: note = MOD_RES - Any amino acid
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVXXKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 1044 - protein, 545 aa, Cannabis sativa
MNCSAFSFWFVCKIIFFFLSFHIQISIANPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 1045 - protein, 545 aa, unidentified
  source 1..545: note = Description of Unknown: Cannabinoid synthase sequence
MNCSTFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAACKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPRHH

SEQ ID NO: 1046 - protein, 545 aa, synthetic construct
  source 1..545: note = Description of Artificial Sequence: Synthetic polypeptide
MFSLKALLPLALLLVSANQVAAKVNPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHHHHHH

SEQ ID NO: 1047 - protein, 544 aa, synthetic construct
  source 1..544: note = Description of Artificial Sequence: Synthetic polypeptide
MFSLKALLPLALLLVSANQVAAKVNPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHHHHH

SEQ ID NO: 1048 - protein, 545 aa, synthetic construct
  source 1..545: note = Description of Artificial Sequence: Synthetic polypeptide
MFSLKALLPLALLLVSANQVAAKVNPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAACKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPRHHHHHH

SEQ ID NO: 1049 - DNA, 1638 bp, synthetic construct; identical to SEQ ID NO: 22
  source 1..1638: mol_type = other DNA; note = Description of Artificial Sequence: Synthetic polynucleotide
  CDS 1..1638: protein_id = 1046; translation = MFSLKALLPLALLLVSANQVAAKVNPRENFLKCFSQYIPNNATNLK LVYTQNNPLYMSVLNSTIHNLRFTSDTTPKPLVIVTPSHVSHIQGTILCSKKVGLQIRT RSGGHDSEGMSYISQVPFVIVDLRNMRSIKIDVHSQTAWVEAGATLGEVYYWVNEKNEN LSLAAGYCPTVCAGGHFGGGGYGPLMRNYGLAADNIIDAHLVNVHGKVLDRKSMGEDLF WALRGGGAESFGIIVAWKIRLVAVPKSTMFSVKKIMEIHELVKLVNKWQNIAYKYDKDL LLMTHFITRNITDNQGKNKTAIHTYFSSVFLGGVDSLVDLMNKSFPELGIKKTDCRQLS WIDTIIFYSGVVNYDTDNFNKEILLDRSAGQNGAFKIKLDYVKKPIPESVFVQILEKLY EEDIGAGMYALYPYGGIMDEISESAIPFPHRAGILYELWYICSWEKQEDNEKHLNWIRN IYNFMTPYVSKNPRLAYLNYRDLDIGINDPKNPNNYTQARIWGEKYFGKNFDRLVKVKT LVDPNNFFRNEQSIPPLPRHRHHHHHH

SEQ ID NO: 1050 - DNA, 1635 bp, synthetic construct; identical to SEQ ID NO: 174
  source 1..1635: mol_type = other DNA; note = Description of Artificial Sequence: Synthetic polynucleotide

SEQ ID NO: 1051 - DNA, 1635 bp, synthetic construct; identical to SEQ ID NO: 412
  source 1..1635: mol_type = other DNA; note = Description of Artificial Sequence: Synthetic polynucleotide

SEQ ID NO: 1052 - protein, 545 aa, Cannabis sativa; identical to SEQ ID NO: 1044

SEQ ID NO: 1053 - protein, 545 aa, Cannabis sativa; identical to SEQ ID NO: 1044

SEQ ID NO: 1054 - protein, 545 aa, Cannabis sativa; identical to SEQ ID NO: 1044

SEQ ID NO: 1055 - protein, 545 aa, Cannabis sativa
MNCSAFSFWFVCKIIFFFLSFHIQISIANPRENFLKCFSKHIPNNVANPKLVYTQHDQLYMSLLNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 1056 - protein, 545 aa, Cannabis sativa; identical to SEQ ID NO: 1044

SEQ ID NO: 1057 - protein, 545 aa, Cannabis sativa; identical to SEQ ID NO: 1044

SEQ ID NO: 1058 - protein, 545 aa, Cannabis sativa
MNCSAFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 1059 - protein, 545 aa, Cannabis sativa; identical to SEQ ID NO: 1058

SEQ ID NO: 1060 - protein, 545 aa, Cannabis sativa
MNCSAFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDSHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 1061 - protein, 545 aa, Cannabis sativa
MNCSAFSFWFVCKIIFFFLSFNIQISLANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIRGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 1062 - protein, 545 aa, Cannabis sativa
MNCSAFSFWFVCKIIFFFLSFNIQISIANPQENFLKCFSEYIPNNPANPKFIYTQHDQLYMSVLNSTIQNLRFTSDATPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 1063 - protein, 545 aa, Cannabis sativa
MNCSAFSFWFVCKIIFFFLSFNIQISLANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 1064 - protein, 545 aa, Cannabis sativa
MNCSAFSFWFVCKIIIFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 1065 - protein, 37 aa, Cannabis sativa
NRQYALVVTVTMVISIIVKLASLMIRLLYPDADSPKV

SEQ ID NO: 1066 - protein, 37 aa, Cannabis sativa
HRKHVLVIINTMVVSIIVKLASVMIKHFFPDAESHAV

SEQ ID NO: 1067 - protein, 37 aa, Cannabis sativa; identical to SEQ ID NO: 1066

SEQ ID NO: 1068 - protein, 37 aa, Cannabis sativa; identical to SEQ ID NO: 1066

SEQ ID NO: 1069 - protein, 37 aa, Cannabis sativa
HRKHVLVLINTMVVSIIVKLASVMIKHFFPDAESHAV

SEQ ID NO: 1070 - protein, 37 aa, Cannabis sativa; identical to SEQ ID NO: 1066

SEQ ID NO: 1071 - protein, 37 aa, Cannabis sativa; identical to SEQ ID NO: 1066

SEQ ID NO: 1072 - protein, 37 aa, Cannabis sativa; identical to SEQ ID NO: 1066

SEQ ID NO: 1073 - protein, 37 aa, Cannabis sativa
NQEYPFIVTVSLAITVVIMFVAMTRRLLYLEVDTPEA

SEQ ID NO: 1074 - protein, 37 aa, Cannabis sativa; identical to SEQ ID NO: 1073

SEQ ID NO: 1075 - protein, 37 aa, Cannabis sativa; identical to SEQ ID NO: 1073

SEQ ID NO: 1076 - protein, 37 aa, Cannabis sativa; identical to SEQ ID NO: 1073

SEQ ID NO: 1077 - protein, 37 aa, Cannabis sativa; identical to SEQ ID NO: 1073

SEQ ID NO: 1078 - protein, 37 aa, Cannabis sativa; identical to SEQ ID NO: 1073

SEQ ID NO: 1079 - protein, 37 aa, Cannabis sativa; identical to SEQ ID NO: 1073

SEQ ID NO: 1080 - protein, 37 aa, Cannabis sativa; identical to SEQ ID NO: 1073

SEQ ID NO: 1081 - protein, 545 aa, synthetic construct; identical to SEQ ID NO: 1046
  source 1..545: note = Description of Artificial Sequence: Synthetic polypeptide

SEQ ID NO: 1082 - protein, 544 aa, Cannabis sativa
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 1083 - protein, 6 aa, synthetic construct
  source 1..6: note = Description of Artificial Sequence: Synthetic 6xHis tag
HHHHHH

What is claimed is:

1. A variant cannabinoid synthase or an active fragment thereof comprising a non-naturally occurring amino acid sequence relative to a wild-type cannabinoid synthase or an active fragment thereof,
   wherein the variant cannabinoid synthase is:
   (i) a cannabidiolic acid (CBDA) synthase comprising an amino acid sequence having greater than 80% sequence identity to SEQ ID NO: 1043 and an amino acid substitution at at least one amino acid position selected from the group consisting of: H69, C180, M256, R295, Q376, N377, A414, and I445;
   (ii) a tetrahydrocannabinolic acid (THCA) synthase comprising an amino acid sequence having greater than 80% sequence identity to SEQ ID NO: 1044 and an amino acid substitution at at least one amino acid position selected from the group consisting of: Q69, G180, I257, K296, K377, K378, V415, and T446; or
   (iii) a cannabichromenic acid (CBCA) synthase comprising an amino acid sequence having greater than 80% sequence identity to SEQ ID NO: 1045 and an amino acid substitution at at least one amino acid position selected from the group consisting of: Q69, G180, I257, R296, K377, K378, V415, and T446.

2. The variant cannabinoid synthase or active fragment thereof of claim 1, wherein the variant cannabinoid synthase is the CBDA synthase comprising the amino acid sequence having greater than 80% sequence identity to SEQ ID NO: 1043 and the amino acid substitution at at least one amino acid position selected from the group consisting of: H69, C180, M256, R295, Q376, N377, A414, and I445.

3. The variant cannabinoid synthase or active fragment thereof of claim 1, wherein the variant cannabinoid synthase is the THCA synthase comprising the amino acid sequence having greater than 80% sequence identity to SEQ ID NO: 1044 and the amino acid substitution at at least one amino acid position selected from the group consisting of: Q69, G180, I257, K296, K377, K378, V415, and T446.

4. The variant cannabinoid synthase or active fragment thereof of claim 1, wherein the variant cannabinoid synthase is the CBCA synthase comprising the amino acid sequence having greater than 80% sequence identity to SEQ ID NO: 1045 and the amino acid substitution at at least one amino acid position selected from the group consisting of: Q69, G180, I257, R296, K377, K378, V415, and T446.

5. The variant cannabinoid synthase or active fragment thereof of claim 1, wherein the variant cannabinoid synthase or active fragment thereof acts on a substrate to produce a cannabinoid, and wherein the cannabinoid is selected from the group consisting of: tetrahydrocannabinolic acid (THCA), tetrahydrocannabinol (THC), tetrahydrocannabinvarin (THCV), cannabidiolic acid (CBDA), cannabidiol (CBD), cannabidivarin (CBDV), cannabichromene (CBC), cannabichromevarin (CBCV), cannabichromenic acid (CBCA), and a combination thereof.

6. The variant cannabinoid synthase or active fragment thereof of claim 5, wherein the substrate is a naturally occurring substrate.

7. The variant cannabinoid synthase or active fragment thereof of claim 6, wherein the naturally occurring substrate is selected from the group consisting of: cannabigerol (CBG), cannabigerolic acid (CBGA), cannabigerovarinic acid (CBGVA), and any homolog thereof.

8. The variant cannabinoid synthase or active fragment thereof of claim 1, wherein the variant cannabinoid synthase or active fragment thereof acts on a non-naturally occurring substrate, and wherein the non-naturally occurring substrate comprises: a non-naturally occurring tail variant, a prenyl donor, or a combination thereof.

9. The variant cannabinoid synthase or active fragment thereof of claim 1, wherein the variant cannabinoid synthase or active fragment thereof acts on a substrate to produce a change in a proportion of a first cannabinoid to a second cannabinoid as compared to a proportion of the first cannabinoid and the second cannabinoid produced by a wild-type cannabinoid synthase.

10. The variant cannabinoid synthase or active fragment thereof of claim 9, wherein the first cannabinoid is CBDA and the second cannabinoid is THCA.

11. The variant cannabinoid synthase or active fragment thereof of claim 10, wherein a proportion of CBDA:THCA produced by a wild type CBDA synthase is about 95:5.

12. The variant cannabinoid synthase or active fragment thereof of claim 1, wherein the CBDA synthase comprises the amino acid substitution at at least one of amino acid positions H69, A414, or I445; the THCA synthase comprises the amino acid substitution at at least one of amino acid positions Q69, V415, or T446; or the CBCA synthase comprises the amino acid substitution at at least one of amino acid positions Q69, V415, or T446.

13. The variant cannabinoid synthase or active fragment thereof of claim 1, wherein the CBDA synthase comprises the amino acid substitution at at least two of amino acid positions H69, A414, or I445 the THCA synthase comprises the amino acid substitution at at least two of amino acid positions Q69, V415, or T446; or the CBCA synthase comprises the amino acid substitution at at least two of amino acid Positions Q69, V415, or T446.

14. The variant cannabinoid synthase or active fragment thereof of claim 1, wherein the CBDA synthase comprises the amino acid substitution at amino acid position H69, and wherein the amino acid substitution at amino acid position H69 is selected from the group consisting of: H69A, H69C, H69D, H69E, H69F, H69G, H69I, H69K, H69L, H69M, H69N, H69P, H69Q, H69R, H69S, H69T, H69V, H69W, and H69Y.

15. The variant cannabinoid synthase or active fragment thereof of claim 1, wherein the CBDA synthase comprises the amino acid substitution at amino acid position A414, and wherein the amino acid substitution at amino acid position A414 is selected from the group consisting of: A414C, A414D, A414E, A414F, A414G, A414H, A414I, A414K, A414L, A414M, A414N, A414P, A414Q, A414R, A414S, A414T, A414V, A414W, and A414Y.

16. The variant cannabinoid synthase or active fragment thereof of claim 1, wherein the CBDA synthase comprises the amino acid substitution at amino acid position I445, and wherein the amino acid substitution at amino acid position I445 is selected from the group consisting of: I445A, I445C, I445D, I445E, I445F, I445G, I445H, I445K, I445L, I445M, I445N, I445P, I445Q, I445R, I445S, I445T, I445V, I445W, and I445Y.

17. The variant cannabinoid synthase or active fragment thereof of claim 1, wherein the THCA synthase or the CBCA synthase comprises the amino acid substitution at amino acid position Q69, and wherein the amino acid substitution at amino acid position Q69 is selected from the group consisting of: Q69A, Q69C, Q69D, Q69E, Q69F, Q69G, Q69H, Q69I, Q69K, Q69L, Q69M, Q69N, Q69P, Q69R, Q69S, Q69T, Q69V, Q69W, and Q69Y.

18. The variant cannabinoid synthase or active fragment thereof of claim 1, wherein the THCA synthase or the CBCA synthase comprises the amino acid substitution at amino acid position V415, and wherein the amino acid substitution at amino acid position V415 is selected from the group consisting of: V415A, V415C, V415D, V415E, V415F, V415G, V415H, V415I, V415K, V415L, V415M, V415N, V415P, V415Q, V415R, V415S, V415T, V415W, and V415Y.

19. The variant cannabinoid synthase or active fragment thereof of claim 1, wherein the THCA synthase or the CBCA synthase comprises the amino acid substitution at amino acid position T446, and wherein the amino acid substitution at amino acid position T446 is selected from the group consisting of: T446A, T446C, T446D, T446E, T446F, T446G, T446H, T446I, T446K, T446L, T446M, T446N, T446P, T446Q, T446R, T446S, T446V, T446W, and T446Y.

20. The variant cannabinoid synthase or active fragment thereof of claim 1, wherein the CBDA synthase comprises the amino acid substitution at amino acid positions H69, A414, and I445; the THCA synthase comprises the amino acid substitution at amino acid positions Q69, V415, and T446; or the CBCA synthase comprises the amino acid substitution at amino acid positions Q69, V415, and T446.

* * * * *